United States Patent 11,723,967 (ZIKA VIRUS VACCINE) - sequence listing, part 7

SEQ ID NO: 8286 - RNA, 2359 nt, Artificial Sequence
  ZIKV prME variant mRNA Design 3 opt
gggagaaagcuuaccaugaucaacgccagaaaggagaaaaagaggcggggcgcugacaccagcguggggauugucggacugcuccuuacaacugcaauggccgcggaaguuacgcgccgagguuccgcuuacuauauguaccuggaucguaaugacgccggcgaggcaauaucuuuccccaccacauuggggaugaacaaaugcuauauccagauuauggauuuaggacacaugugugacgccacuaugucauacgaaugcccuaugcuggaugagggcguggaaccagacgauguagacuguuggugcaauaccacaaguaccuggguggucuaugguacuugucaucacaagaaaggggaggcuagaaggagccggcgcgcagugacacuaccgucccauucuaccagaaagcuccaaacgaggucgcagacuuggcuggagucacgggaauacaccaagcaccuuauccgcguugagaacuggauuuuucgaaaucccggauucgcccuggcugccgcggcaaucgccugguugcucggcagcaguacaucccagaaagugauauaucuggucaugauccugcucauugcuccugccuacucuaucagaugcauuggcgugagcaacagggauuuuguagaagggauguccggagguacuuggguugacaucguguuagagcauggcgggugugucaccgugauggcacaggauaagccaacaguggacauagagcuggucaccacgacuguuucaaauauggcugaagugcggaguuacugcuaugaggccagcauuucugauauggcguccgacucacguugucccacacaaggagaagccuaccuugacaaacagagcgauacccaguauguaugcaagcgcacuuugguggacagaggcugggguaacggguguggacuguucggcaaaggcagucuagucacaugcgcaaaguuugcuugcucuaagaaaaugaccgggaaguccauccagccugagaaucucgaauacaggauuaugcugagcgugcacggaucgcaacacucugguaugaucguuaacgauacgggccaugagaccgacgagaaucgggccaaaguggaaaucacaccaaacucaccccgagcugaggccacucuugggggauucggcucccuggguuuggauugugaaccucgcaccgggcucgacuuuagugaucuguauuacuuaacaaugaauaacaagcacuggcugguccauaaagagugguuccacgacauuccacucccguggcacgcaggcgccgauacuggaacaccccauuggaauaacaaggaagcucuuguggaguuuaaagacgcgcacgcaaagagacagaccguaguugugcugggcagccaggagggggccguccauaccgcuuuggccggagcacuagaagccgagauggauggugcuaagggcaggcuguccucugggcaccucaaaugccggcugaagauggacaaacuucgccugaagggagugagcuauucauuguguacugccgcauucacguuuacaaaaauaccugcggaaacccuccauggcacugucaccguggagguucaguacgcugguacagacgggccaugcaaggugcccgcccaaauggcaguagauaugcagacccugacuccugucggcagauuaaucacagccaacccagugauuacggaaaguaccgaaaauuccaagaugaugcuggagcuagaucccccguucggagacagcuacaucguuauaggcgugggggagaaaaagauuacucaccacuggcauaggucuggaucaacaaucgguaaggcuuuugaggccaccguccguggcgcaaaacggauggcugugcucggggacacagccugggauuucggaaguguaggcggugcgcugaacagccuugggaaaggcauccaccagauuuucggagccgcuuuuaaguccuuguucggcgggaugucuugguuuucgcaaauccugauuggaacucuccugauguggcuuggccugaauaccaagaacgguagcauauccuugaugugucucgcauuagggggagugcugaucuuccugucaacggccguuagugcugacgucggcugcucuguggauuuuagcaaaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8287 - RNA, 2356 nt, Artificial Sequence
  ZIKV prME variant mRNA Design 3 opt
gggagaaagcuuaccaugaacgccagaaaggagaaaaagaggcggggcgcugacaccagcguggggaucgucggacugcuccuuacaacugcaauggccgcggaaguuacgcgccgagguuccgcuuacuauauguaccuggaucguaaugacgccggcgaggcaauuucuuuccccaccacauuggggaugaacaaaugcuauauacagaucauggauuuaggacacaugugugacgccacuaugucauacgaaugcccuaugcuggaugagggcguggaaccagacgauguagacuguuggugcaauaccacaaguaccuggguggucuaugguacuugucaucacaagaaaggggaggcuagaaggagccggcgcgcagugacacuaccgucccauucuaccagaaagcuccaaacgaggucgcagacuuggcuggagucacgggaauacaccaagcaccuuauucgcguugagaacuggaucuuucgaaaucccggauucgcccuggcugccgcggcaauugccugguugcucggcagcaguacaucccagaaagugaucuaucuggucaugauacugcucaucgcuccugccuacucuauuagaugcaucggcgugagcaacagggauuuuguagaagggauguccggagguacuuggguugacauuguguuagagcauggcgggugugucaccgugauggcacaggauaagccaacaguggacaucgagcuggucaccacgacuguuucaaauauggcugaagugcggaguuacugcuaugaggccagcauaucugauauggcguccgacucacguugucccacacaaggagaagccuaccuugacaaacagagcgauacccaguauguaugcaagcgcacuuugguggacagaggcugggguaacggguguggacuguucggcaaaggcagucuagucacaugcgcaaaguuugcuugcucuaagaaaaugaccgggaaguccauucagccugagaaucucgaauacaggaucaugcugagcgugcacggaucgcaacacucugguaugauuguuaacgauacgggccaugagaccgacgagaaucgggccaaaguggaaaucacaccaaacucaccccgagcugaggccacucuugggggauucggcucccuggguuuggauugugaaccucgcaccgggcucgacuuuagugaucuguauuacuuaacaaugaauaacaagcacuggcugguccauaaagagugguuccacgacaucccacucccguggcacgcaggcgccgauacuggaacaccccauuggaauaacaaggaagcucuuguggaguuuaaagacgcgcacgcaaagagacagaccguaguugugcugggcagccaggagggggccguccauaccgcuuuggccggagcacuagaagccgagauggauggugcuaagggcaggcuguccucugggcaccucaaaugccggcugaagauggacaaacuucgccugaagggagugagcuauucauuguguacugccgcauucacguuuacaaaaauuccugcggaaacccuccauggcacugucaccguggagguucaguacgcugguacagacgggccaugcaaggugcccgcccaaauggcaguagauaugcagacccugacuccugucggcagauuaauaacagccaacccagugaucacggaaaguaccgaaaauuccaagaugaugcuggagcuagaucccccguucggagacagcuacauuguuaucggcgugggggagaaaaagauaacucaccacuggcauaggucuggaucaacaauugguaaggcuuuugaggccaccguccguggcgcaaaacggauggcugugcucggggacacagccugggauuucggaaguguaggcggugcgcugaacagccuugggaaaggcauccaccagaucuucggagccgcuuuuaaguccuuguucggcgggaugucuugguuuucgcaaauucugaucggaacucuccugauguggcuuggccugaauaccaagaacgguagcauuuccuugaugugucucgcauuagggggagugcugauauuccugucaacggccguuagugcugacgucggcugcucuguggauuuuagcaaaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8288 - RNA, 2353 nt, Artificial Sequence
  ZIKV prME variant mRNA Design 3 opt
gggagaaagcuuaccauggccagaaaggagaaaaagaggcggggcgcugacaccagcguggggaucgucggacugcuccuuacaacugcaauggccgcggaaguuacgcgccgagguuccgcuuacuauauguaccuggaucguaacgacgccggcgaggcaauuucuuuccccaccacauuggggaugaauaaaugcuauauacagaucauggauuuaggacacaugugugacgccacuaugucauacgaaugcccuaugcuggaugagggcguggaaccagacgauguagacuguuggugcaacaccacaaguaccuggguggucuaugguacuugucaucacaagaaaggggaggcuagaaggagccggcgcgcagugacacuaccgucccauucuaccagaaagcuccaaacgaggucgcagacuuggcuggagucacgggaauacaccaagcaccuuauucgcguugagaauuggaucuuucgaaaccccggauucgcccuggcugccgcggcaauugccugguugcucggcagcaguacaucccagaaagugaucuaucuggucaugauacugcucaucgcuccugccuacucuauuagaugcaucggcgugagcaauagggauuuuguagaagggauguccggagguacuuggguugacauuguguuagagcauggcgggugugucaccgugauggcacaggauaagccaacaguggacaucgagcuggucaccacgacuguuucaaacauggcugaagugcggaguuacugcuaugaggccagcauaucugauauggcguccgacucacguugucccacacaaggagaagccuaccuugacaaacagagcgauacccaguauguaugcaagcgcacuuugguggacagaggcugggguaauggguguggacuguucggcaaaggcagucuagucacaugcgcaaaguuugcuugcucuaagaaaaugaccgggaaguccauucagccugagaaccucgaauacaggaucaugcugagcgugcacggaucgcaacacucugguaugauuguuaaugauacgggccaugagaccgacgagaaccgggccaaaguggaaaucacaccaaauucaccccgagcugaggccacucuugggggauucggcucccuggguuuggauugugaaccucgcaccgggcucgacuuuagugaucuguauuacuuaacaaugaacaauaagcacuggcugguccauaaagagugguuccacgacaucccacucccguggcacgcaggcgccgauacuggaacaccccauuggaacaauaaggaagcucuuguggaguuuaaagacgcgcacgcaaagagacagaccguaguugugcugggcagccaggagggggccguccauaccgcuuuggccggagcacuagaagccgagauggauggugcuaagggcaggcuguccucugggcaccucaaaugccggcugaagauggacaaacuucgccugaagggagugagcuauucauuguguacugccgcauucacguuuacaaaaauuccugcggaaacccuccauggcacugucaccguggagguucaguacgcugguacagacgggccaugcaaggugcccgcccaaauggcaguagauaugcagacccugacuccugucggcagauuaauaacagccaacccagugaucacggaaaguaccgagaacuccaagaugaugcuggagcuagaucccccguucggagacagcuacauuguuaucggcgugggggagaaaaagauaacucaccacuggcauaggucuggaucaacaauugguaaggcuuuugaagccaccguccguggcgcaaaacggauggcugugcucggggacacagccugggauuucggaaguguaggcggugcgcugaauagccuugggaaaggcauccaccagaucuucggagccgcuuuuaaguccuuguucggcgggaugucuugguuuucgcaaauucugaucggaacucuccugauguggcuuggccugaacaccaagaaugguagcauuuccuugaugugucucgcauuagggggagugcugauauuccugucaacggccguuagugcugacgucggcugcucuguggauuuuagcaaaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8289 - RNA, 2350 nt, Artificial Sequence
  ZIKV prME variant mRNA Design 3 opt
gggagaaagcuuaccaugagaaaggagaaaaagaggcggggcgccgacaccagcguggggaucgucggacugcuccuuacaacugcuauggcagccgaaguuacgcgccgagguuccgcguacuauauguaccuggaucguaacgacgcuggcgaggccauuucuuuccccaccacauuggggaugaauaaaugcuauauacagaucauggauuuaggacacaugugugacgcaacuaugucauacgaaugcccuaugcuggaugagggcguggaaccagacgauguagacuguuggugcaacaccacaaguaccuggguggucuaugguacuugucaucacaagaaaggggaggccagaaggagccggcgcgcugugacacuaccgucccauucuaccagaaagcuccaaacgaggucgcagacuuggcuggagucacgggaauacaccaagcaccuuauucgcguugagaauuggaucuuucgaaaccccggauucgcacuggccgcugccgcgauugcaugguugcucggcagcaguacaucccagaaagugaucuaucuggucaugauacugcucaucgccccugcuuacucuauuagaugcaucggcgugagcaauagggauuuuguagaagggauguccggagguacuuggguugacauuguguuagagcauggcgggugugucaccgugauggcccaggauaagccaacaguggacaucgagcuggucaccacgacuguuucaaacauggcagaagugcggaguuacugcuaugaggcuagcauaucugauauggccuccgacucacguugucccacacaaggagaagcguaccuugacaaacagagcgauacccaguauguaugcaagcgcacuuugguggacagaggcugggguaauggguguggacuguucggcaaaggcagucuagucacaugcgccaaguuugcaugcucuaagaaaaugaccgggaaguccauucagccugagaaccucgaauacaggaucaugcugagcgugcacggaucgcaacacucugguaugauuguuaaugauacgggccaugagaccgacgagaaccgggcuaaaguggaaaucacaccaaauucaccccgagccgaggcuacucuugggggauucggcucccuggguuuggauugugaaccucgcaccgggcucgacuuuagugaucuguauuacuuaacaaugaacaauaagcacuggcugguccauaaagagugguuccacgacaucccacucccguggcacgccggcgcagauacuggaacaccccauuggaacaauaaggaagcccuuguggaguuuaaagacgcucacgcgaagagacagaccguaguugugcugggcagccaggagggggcaguccauaccgccuuggcuggagcccuagaagcagagauggauggugccaagggcaggcuguccucugggcaccucaaaugccggcugaagauggacaaacuucgccugaagggagugagcuauucauuguguacugcugccuucacguuuacaaaaauuccugcagaaacccuccauggcacugucaccguggagguucaguacgcggguacagacgggccaugcaaggugcccgcucaaauggccguagauaugcagacccugacuccugucggcagauuaauaacagcaaacccagugaucacggaaaguaccgagaacuccaagaugaugcuggagcuagaucccccguucggagacagcuacauuguuaucggcgugggggagaaaaagauaacucaccacuggcauaggucuggaucaacaauugguaaagccuuugaagcuaccguccguggcgccaagcggauggcagugcucggggacacagcuugggauuucggaaguguaggcggugcccugaauagccuugggaaaggcauccaccagaucuucggagcggccuuuaaguccuuguucggcgggaugucuugguuuucgcaaauucugaucggaacucuccugauguggcuuggccugaacaccaagaaugguagcauuuccuugaugugucucgcuuuagggggagugcugauauuccugucaacggcaguuagugccgacgucggcugcucuguggauuuuagcaaaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8290 - RNA, 2347 nt, Artificial Sequence
  ZIKV prME variant mRNA Design 3 opt
gggagaaagcuuaccaugaaggagaaaaagagaaggggcgccgacaccagcguggggaucgucggacugcuccuuacaacugcuauggcagccgaaguuacgcggcgcgguuccgcguacuauauguaccuggaucgaaacgacgcuggcgaggccauuucuuuccccaccacauuggggaugaauaaaugcuauauacagaucauggauuuaggacacaugugugacgcaacuaugucauacgaaugcccuaugcuggaugagggcguggaaccagacgauguagacuguuggugcaacaccacaaguaccuggguggucuaugguacuugucaucacaagaaaggggaggcccguagaagcaggcgggcugugacacuaccgucccauucuacccgcaagcuccaaacgagaucgcagacuuggcuggagucaagggaauacaccaagcaccuuauucggguugagaauuggaucuuucgcaaccccggauucgcacuggccgcugccgcgauugcaugguugcucggcagcaguacaucccagaaagugaucuaucuggucaugauacugcucaucgccccugcuuacucuauucgaugcaucggcgugagcaauagagauuuuguagaagggauguccggagguacuuggguugacauuguguuagagcauggcgggugugucaccgugauggcccaggauaagccaacaguggacaucgagcuggucaccacgacuguuucaaacauggcagaagugaggaguuacugcuaugaggcuagcauaucugauauggccuccgacucacggugucccacacaaggagaagcguaccuugacaaacagagcgauacccaguauguaugcaagcguacuuugguggaccgcggcugggguaauggguguggacuguucggcaaaggcagucuagucacaugcgccaaguuugcaugcucuaagaaaaugaccgggaaguccauucagccugagaaccucgaauacagaaucaugcugagcgugcacggaucgcaacacucugguaugauuguuaaugauacgggccaugagaccgacgagaacagggcuaaaguggaaaucacaccaaauucaccccgggccgaggcuacucuugggggauucggcucccuggguuuggauugugaaccucgaaccgggcucgacuuuagugaucuguauuacuuaacaaugaacaauaagcacuggcugguccauaaagagugguuccacgacaucccacucccguggcacgccggcgcagauacuggaacaccccauuggaacaauaaggaagcccuuguggaguuuaaagacgcucacgcgaagcgccagaccguaguugugcugggcagccaggagggggcaguccauaccgccuuggcuggagcccuagaagcagagauggauggugccaagggcagacuguccucugggcaccucaaaugcaggcugaagauggacaaacuucggcugaagggagugagcuauucauuguguacugcugccuucacguuuacaaaaauuccugcagaaacccuccauggcacugucaccguggagguucaguacgcggguacagacgggccaugcaaggugcccgcucaaauggccguagauaugcagacccugacuccugucggccgcuuaauaacagcaaacccagugaucacggaaaguaccgagaacuccaagaugaugcuggagcuagaucccccguucggagacagcuacauuguuaucggcgugggggagaaaaagauaacucaccacuggcauagaucuggaucaacaauugguaaagccuuugaagcuaccgucaggggcgccaagcguauggcagugcucggggacacagcuugggauuucggaaguguaggcggugcccugaauagccuugggaaaggcauccaccagaucuucggagcggccuuuaaguccuuguucggcgggaugucuugguuuucgcaaauucugaucggaacucuccugauguggcuuggccugaacaccaagaaugguagcauuuccuugaugugucucgcuuuagggggagugcugauauuccugucaacggcaguuagugccgacgucggcugcucuguggauuuuagcaaaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8291 - RNA, 2344 nt, Artificial Sequence
  ZIKV prME variant mRNA Design 3 opt
gggagaaagcuuaccauggagaagaaaagaaggggcgccgacaccagcguggggaucgucggacugcuccuuacaacugcuauggcagccgaaguuacgcggcgcgguuccgcguacuauauguaccuggaucgaaacgacgcuggcgaggccauuucuuuccccaccacauuggggaugaauaagugcuauauacagaucauggauuuaggacacaugugugacgcaacuaugucauacgaaugcccuaugcuggaugagggcguggaaccagacgauguagacuguuggugcaacaccacaaguaccuggguggucuaugguacuugucaucacaaaaagggggaggcccguagaagcaggcgggcugugacacuaccgucccauucuacccgcaaacuccaaacgagaucgcagacuuggcuggagucaagggaauacaccaagcaccuuauucggguugagaauuggaucuuucgcaaccccggauucgcacuggccgcugccgcgauugcaugguugcucggcagcaguacaucccagaaggugaucuaucuggucaugauacugcucaucgccccugcuuacucuauucgaugcaucggcgugagcaauagagauuuuguagaagggauguccggagguacuuggguugacauuguguuagagcauggcgggugugucaccgugauggcccaggauaaaccaacaguggacaucgagcuggucaccacgacuguuucaaacauggcagaagugaggaguuacugcuaugaggcuagcauaucugauauggccuccgacucacggugucccacacaaggagaagcguaccuugacaagcagagcgauacccaguauguaugcaaacguacuuugguggaccgcggcugggguaauggguguggacuguucggcaagggcagucuagucacaugcgccaaauuugcaugcucuaagaagaugaccgggaaauccauucagccugagaaccucgaauacagaaucaugcugagcgugcacggaucgcaacacucugguaugauuguuaaugauacgggccaugagaccgacgagaacagggcuaagguggaaaucacaccaaauucaccccgggccgaggcuacucuugggggauucggcucccuggguuuggauugugaaccucgaaccgggcucgacuuuagugaucuguauuacuuaacaaugaacaauaaacacuggcugguccauaaggagugguuccacgacaucccacucccguggcacgccggcgcagauacuggaacaccccauuggaacaauaaagaagcccuuguggaguuuaaggacgcucacgcgaaacgccagaccguaguugugcugggcagccaggagggggcaguccauaccgccuuggcuggagcccuagaagcagagauggauggugccaagggcagacuguccucugggcaccucaagugcaggcugaaaauggacaagcugcggcugaaaggagugagcuauucauuguguacugcugccuucacguuuacaaagauuccugcagaaacccuccauggcacugucaccguggagguucaguacgcggguacagacgggccaugcaaagugcccgcucaaauggccguagauaugcagacccugacuccugucggccgcuuaauaacagcaaacccagugaucacggaaaguaccgagaacuccaagaugaugcuggagcuagaucccccguucggagacagcuacauuguuaucggcgugggggaaaagaaaauaacucaccacuggcauagaucuggaucaacaauugguaaggccuuugaggcuaccgucaggggcgccaaacguauggcagugcucggggacacagcuugggauuucggaaguguaggcggugcccugaauagccuugggaagggcauccaccagaucuucggagcggccuuuaaauccuuguucggcgggaugucuugguuuucgcaaauucugaucggaacucuccugauguggcuuggccugaacaccaagaaugguagcauuuccuugaugugucucgcucuugggggaguguuaauauuccugucaacggcaguuagugccgacgucggcugcucuguggauuuuagcaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8292 - RNA, 2341 nt, Artificial Sequence
  ZIKV prME variant mRNA Design 3 opt
gggagaaagcuuaccaugaagaaaagaaggggcgccgacaccagcguggggaucgucggacugcuccuuacaacugcuauggcagccgagguuacgcggcgcgguuccgcguacuauauguaccuggaucgaaacgacgcuggcgaagccauuucuuuccccaccacauuggggaugaauaagugcuauauacagaucauggauuuaggacacaugugugacgcaacuaugucauacgagugcccuaugcuggaugaaggcguggagccagacgauguagacuguuggugcaacaccacaaguaccuggguggucuaugguacuugucaucacaaaaagggggaagcccguagaagcaggcgggcugugacacuaccgucccauucuacccgcaaacuccaaacgagaucgcagacuuggcuggagucaagggaguacaccaagcaccuuauucggguugaaaauuggaucuuucgcaaccccggauucgcacuggccgcugccgcgauugcaugguugcucggcagcaguacaucccagaaggugaucuaucuggucaugauacugcucaucgccccugcuuacucuauucgaugcaucggcgugagcaauagagauuuuguagaggggauguccggagguacuuggguugacauuguguuagaacauggcgggugugucaccgugauggcccaggauaaaccaacaguggacaucgagcuggucaccacgacuguuucaaacauggcagaggugaggaguuacugcuaugaagcuagcauaucugauauggccuccgacucacggugucccacacaaggagaggcguaccuugacaagcagagcgauacccaguauguaugcaaacguacuuugguggaccgcggcugggguaauggguguggacuguucggcaagggcagucuagucacaugcgccaaauuugcaugcucuaagaagaugaccgggaaauccauucagccugaaaaccucgaguacagaaucaugcugagcgugcacggaucgcaacacucugguaugauuguuaaugauacgggccaugaaaccgacgagaacagggcuaagguggagaucacaccaaauucaccccgggccgaagcuacucuugggggauucggcucccuggguuuggauugugagccucgaaccgggcucgacuuuagugaucuguauuacuuaacaaugaacaauaaacacuggcugguccauaaggaaugguuccacgacaucccacucccguggcacgccggcgcagauacuggaacaccccauuggaacaauaaagaggcccuuguggaauuuaaggacgcucacgcgaaacgccagaccguaguugugcugggcagccaggagggggcaguccauaccgccuuggcuggagcccuagaggcagaaauggauggugccaagggcagacuguccucugggcaccucaagugcaggcugaaaauggacaagcugcggcugaaaggagugagcuauucauuguguacugcugccuucacguuuacaaagauuccugcagagacccuccauggcacugucaccguggaaguucaguacgcggguacagacgggccaugcaaagugcccgcucaaauggccguagauaugcagacccugacuccugucggccgcuuaauaacagcaaacccagugaucacggagaguaccgaaaacuccaagaugaugcuggagcuagaucccccguucggagacagcuacauuguuaucggcgugggggagaagaaaauaacucaccacuggcauagaucuggaucaacaauugguaaggccuuugaagcuaccgucaggggcgccaaacguauggcagugcucggggacacagcuugggauuucggaaguguaggcggugcccugaauagccuugggaagggcauccaccagaucuucggagcggccuuuaaauccuuguucggcgggaugucuugguuuucgcaaauucugaucggaacucuccugauguggcuuggccugaacaccaagaaugguagcauuuccuugaugugucucgcucuugggggaguguuaauauuccugucaacggcaguuagugccgacgucggcugcucuguggauuuuagcaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8293 - RNA, 2338 nt, Artificial Sequence
  ZIKV prME variant mRNA Design 3 opt
gggagaaagcuuaccaugaagagaaggggcgccgacaccagcguggggaucgucggacugcuccuuacaacugcuauggcagccgagguuacgcggcgcgguuccgcguacuauauguaccuggaucgaaacgacgcuggcgaagccauuucuuuccccaccacauuggggaugaauaaaugcuauauacagaucauggauuuaggacacaugugugacgcaacuaugucauacgagugcccuaugcuggaugaaggcguggagccagacgauguagacuguuggugcaacaccacaaguaccuggguggucuaugguacuugucaucacaagaaaggggaagcccguagaagcaggcgggcugugacacuaccgucccauucuacccgcaagcuccaaacgagaucgcagacuuggcuggagucaagggaguacaccaaacaccuuauucggguugaaaauuggaucuuucgcaaccccggauucgcacuggccgcugccgcgauugcaugguugcucggcagcaguacaucccagaaggugaucuaucuggucaugauacugcucaucgccccugcuuacucuauucgaugcaucggcgugagcaauagagauuuuguagaggggauguccggagguacuuggguugacauuguguuagaacauggcgggugugucaccgugauggcccaggauaagccaacaguggacaucgagcuggucaccacgacuguuucaaacauggcagaggugaggaguuacugcuaugaagcuagcauaucugauauggccuccgacucacggugucccacacaaggagaggcguaccuugacaaacagagcgauacccaguauguaugcaagcguacuuugguggaccgcggcugggguaauggguguggacuguucggcaaaggcagucuagucacaugcgccaaguuugcaugcucuaaaaagaugaccgggaaguccauucagccugaaaaccucgaguacagaaucaugcugagcgugcacggaucgcaacacucugguaugauuguuaaugauacgggccaugaaaccgacgagaacagggcuaaaguggagaucacaccaaauucaccccgggccgaagcuacucuugggggauucggcucccuggguuuggauugugagccucgaaccgggcucgacuuuagugaucuguauuacuuaacaaugaacaauaagcacuggcugguccauaaagaaugguuccacgacaucccacucccguggcacgccggcgcagauacuggaacaccccauuggaacaauaaggaggcccuuguggaauuuaaagacgcucacgcgaagcgccagaccguaguugugcugggcagccaggagggggcaguccauaccgccuuggcuggagcccuagaggcagaaauggauggugccaaaggcagacuguccucugggcaccucaagugcaggcugaagauggacaaacuucggcugaagggagugagcuauucauuguguacugcugccuucacguuuacaaaaauuccugcagagacccuccauggcacugucaccguggaaguucaguacgcggguacagacgggccaugcaaggugcccgcucaaauggccguagauaugcagacccugacuccugucggccgcuuaauaacagcaaacccagugaucacggagaguaccgaaaacuccaaaaugaugcuggagcuagaucccccguucggagacagcuacauuguuaucggcgugggggagaagaagauaacucaccacuggcauagaucuggaucaacaauugguaaagccuuugaagcuaccgucaggggcgccaagcguauggcagugcucggggacacagcuugggauuucggaaguguaggcggugcccugaauagccuugggaaaggcauccaccagaucuucggagcggccuuuaaguccuuguucggcgggaugucuugguuuucgcaaauucugaucggaacucuccugauguggcuuggccugaacaccaaaaaugguagcauuuccuugaugugucucgcuuuagggggagugcugauauuccugucaacggcaguuagugccgacgucggcugcucuguggauuuuagcaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8294 - RNA, 2335 nt, Artificial Sequence
  ZIKV prME variant mRNA Design 3 opt
gggagaaagcuuaccaugagaaggggcgccgacaccagcguggggaucgucggacugcuccuuacaacugcuauggcagccgagguuacgcggcgcgguuccgcguacuauauguaccuggaucgaaacgacgcuggcgaagccauuucuuuccccaccacauuggggaugaauaagugcuauauacagaucauggauuuaggacacaugugugacgcaacuaugucauacgagugcccuaugcuggaugaaggcguggagccagacgauguagacuguuggugcaacaccacaaguaccuggguggucuaugguacuugucaucacaaaaagggggaagcccguagaagcaggcgggcugugacacuaccgucccauucuacccgcaaacuccaaacgagaucgcagacuuggcuggagucaagggaguacaccaagcaccuuauucggguugaaaauuggaucuuucgcaaccccggauucgcacuggccgcugccgcgauugcaugguugcucggcagcaguacaucccagaaagugaucuaucuggucaugauacugcucaucgccccugcuuacucuauucgaugcaucggcgugagcaauagagauuuuguagaggggauguccggagguacuuggguugacauuguguuagaacauggcgggugugucaccgugauggcccaggauaagccaacaguggacaucgagcuggucaccacgacuguuucaaacauggcagaggugaggaguuacugcuaugaagcuagcauaucugauauggccuccgacucacggugucccacacaaggagaggcguaccuugacaagcagagcgauacccaguauguaugcaaacguacuuugguggaccgcggcugggguaauggguguggacuguucggcaagggcagucuagucacaugcgccaaauuugcaugcucuaagaaaaugaccgggaaguccauucagccugaaaaccucgaguacagaaucaugcugagcgugcacggaucgcaacacucugguaugauuguuaaugauacgggccaugaaaccgacgagaacagggcuaagguggagaucacaccaaauucaccccgggccgaagcuacucuugggggauucggcucccuggguuuggauugugagccucgaaccgggcucgacuuuagugaucuguauuacuuaacaaugaacaauaaacacuggcugguccauaaggaaugguuccacgacaucccacucccguggcacgccggcgcagauacuggaacaccccauuggaacaauaaagaggcccuuguggaauuuaaggacgcucacgcgaaacgccagaccguaguugugcugggcagccaggagggggcaguccauaccgccuuggcuggagcccuagaggcagaaauggauggugccaagggcagacuguccucugggcaccucaaaugcaggcugaagauggacaagcugcggcugaaaggagugagcuauucauuguguacugcugccuucacguuuacaaagauuccugcagagacccuccauggcacugucaccguggaaguucaguacgcggguacagacgggccaugcaaagugcccgcucaaauggccguagauaugcagacccugacuccugucggccgcuuaauaacagcaaacccagugaucacggagaguaccgaaaacuccaagaugaugcuggagcuagaucccccguucggagacagcuacauuguuaucggcgugggggagaaaaagauaacucaccacuggcauagaucuggaucaacaauugguaaggccuuugaagcuaccgucaggggcgccaaacguauggcagugcucggggacacagcuugggauuucggaaguguaggcggugcccugaauagccuugggaagggcauccaccagaucuucggagcggccuuuaaauccuuguucggcgggaugucuugguuuucgcaaauucugaucggaacucuccugauguggcuuggccugaacaccaagaaugguagcauuuccuugaugugucucgcucuugggggaguguuaauauuccugucaacggcaguuagugccgacgucggcugcucuguggauuuuagcaaaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8295 - RNA, 2332 nt, Artificial Sequence
  ZIKV prME variant mRNA Design 3 opt
gggagaaagcuuaccaugagaggcgccgacaccagcguggggaucgucggacugcuccuuacaacugcuauggcagccgagguuacgaggcgggguuccgcguacuauauguaccuggaucgcaacgacgcuggcgaagccauuucuuuccccaccacauuggggaugaauaagugcuauauacagaucauggauuuaggacacaugugugacgcaacuaugucauacgagugcccuaugcuggaugaaggcguggagccagacgauguagacuguuggugcaacaccacaaguaccuggguggucuaugguacuugucaucacaaaaagggggaagcccgacguagcagaagggcugugacacuaccgucccauucuacccggaaacuccaaacgcgcucgcagacuuggcuggagucaagagaguacaccaagcaccuuauuaggguugaaaauuggaucuuucggaaccccggauucgcacuggccgcugccgcgauugcaugguugcucggcagcaguacaucccagaaagugaucuaucuggucaugauacugcucaucgccccugcuuacucuauucgcugcaucggcgugagcaaucgagauuuuguagaggggauguccggagguacuuggguugacauuguguuagaacauggcgggugugucaccgugauggcccaggauaagccaacaguggacaucgagcuggucaccacgacuguuucaaacauggcagaggugagaaguuacugcuaugaagcuagcauaucugauauggccuccgacucaaggugucccacacaaggagaggcguaccuugacaagcagagcgauacccaguauguaugcaaacggacuuugguggaccguggcugggguaauggguguggacuguucggcaagggcagucuagucacaugcgccaaauuugcaugcucuaagaaaaugaccgggaaguccauucagccugaaaaccucgaguaccgcaucaugcugagcgugcacggaucgcaacacucugguaugauuguuaaugauacgggccaugaaaccgacgagaacagagcuaagguggagaucacaccaaauucccccagggccgaagcuacucuugggggauucggcucacuggguuuggauugugagccucggaccgggcucgacuuuagugaucuguauuacuuaacaaugaacaauaaacacuggcugguccauaaggaaugguuccacgacaucccacucccguggcacgccggcgcagauacuggaacaccccauuggaacaauaaagaggcccuuguggaauuuaaggacgcucacgcgaaacgacagaccguaguugugcugggcagccaggagggggcaguccauaccgccuuggcuggagcccuagaggcagaaauggauggugccaagggccgccuguccucugggcaccucaaaugcagacugaagauggacaagcugaggcugaaaggagugagcuauucauuguguacugcugccuucacguuuacaaagauuccugcagagacccuccauggcacugucaccguggaaguucaguacgcggguacagacgggccaugcaaagugcccgcucaaauggccguagauaugcagacccugacuccugucggccgguuaauaacagcaaacccagugaucacggagaguaccgaaaacuccaagaugaugcuggagcuagaucccccguucggagacagcuacauuguuaucggcgugggggagaaaaagauaacucaccacuggcaucgcucuggaucaacaauugguaaggccuuugaagcuaccgucagaggcgccaaaaggauggcagugcucggggacacagcuugggauuucggaaguguaggcggugcccugaauagccuugggaagggcauccaccagaucuucggagcggccuuuaaauccuuguucggcgggaugucuugguuuucgcaaauucugaucggaacucuccugauguggcuuggccugaacaccaagaaugguagcauuuccuugaugugucucgcucuugggggaguguuaauauuccugucaacggcaguuagugccgacgucggcugcucuguggauuuuagcaaaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8296 - RNA, 2329 nt, Artificial Sequence
  ZIKV prME variant mRNA Design 3 opt
gggagaaagcuuaccaugggcgccgacaccagcguggggaucgucggacugcuccuuacaacugcuauggcagccgagguuacgagaagggguuccgcguacuauauguaccuggaucggaacgacgcuggcgaagccauuucuuuccccaccacauuggggaugaauaagugcuauauacagaucauggauuuaggacacaugugugacgcaacuaugucauacgagugcccuaugcuggaugaaggcguggagccagacgauguagacuguuggugcaacaccacaaguaccuggguggucuaugguacuugucaucacaaaaagggggaagcccgccgaagccguagagcugugacacuaccgucccauucuaccaggaaacuccaaacgcggucgcagacuuggcuggagucacgcgaguacaccaagcaccuuauuagaguugaaaauuggaucuuuaggaaccccggauucgcacuggccgcugccgcgauugcaugguugcucggcagcaguacaucccagaaagugaucuaucuggucaugauacugcucaucgccccugcuuacucuauucggugcaucggcgugagcaaucgcgauuuuguagaggggauguccggagguacuuggguugacauuguguuagaacauggcgggugugucaccgugauggcccaggauaagccaacaguggacaucgagcuggucaccacgacuguuucaaacauggcagaggugcgaaguuacugcuaugaagcuagcauaucugauauggccuccgacucaagaugucccacacaaggagaggcguaccuugacaagcagagcgauacccaguauguaugcaaaaggacuuugguggaccggggcugggguaauggguguggacuguucggcaagggcagucuagucacaugcgccaaauuugcaugcucuaagaaaaugaccgggaaguccauucagccugaaaaccucgaguaccguaucaugcugagcgugcacggaucgcaacacucugguaugauuguuaaugauacgggccaugaaaccgacgagaaccgcgcuaagguggagaucacaccaaauucccccagagccgaagcuacucuugggggauucggcucacuggguuuggauugugagccuaggaccgggcucgacuuuagugaucuguauuacuuaacaaugaacaauaaacacuggcugguccauaaggaaugguuccacgacaucccacucccguggcacgccggcgcagauacuggaacaccccauuggaacaauaaagaggcccuuguggaauuuaaggacgcucacgcgaaacggcagaccguaguugugcugggcagccaggagggggcaguccauaccgccuuggcuggagcccuagaggcagaaauggauggugccaagggccgacuguccucugggcaccucaaaugccgccugaagauggacaagcugagacugaaaggagugagcuauucauuguguacugcugccuucacguuuacaaagauuccugcagagacccuccauggcacugucaccguggaaguucaguacgcggguacagacgggccaugcaaagugcccgcucaaauggccguagauaugcagacccugacuccugucggcagguuaauaacagcaaacccagugaucacggagaguaccgaaaacuccaagaugaugcuggagcuagaucccccguucggagacagcuacauuguuaucggcgugggggagaaaaagauaacucaccacuggcaucggucuggaucaacaauugguaaggccuuugaagcuaccguccgcggcgccaaaagaauggcagugcucggggacacagcuugggauuucggaaguguaggcggugcccugaauagccuugggaagggcauccaccagaucuucggagcggccuuuaaauccuuguucggcgggaugucuugguuuucgcaaauucugaucggaacucuccugauguggcuuggccugaacaccaagaaugguagcauuuccuugaugugucucgcucuugggggaguguuaauauuccugucaacggcaguuagugccgacgucggcugcucuguggauuuuagcaaaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8297 - RNA, 2326 nt, Artificial Sequence
  ZIKV prME variant mRNA Design 3 opt
gggagaaagcuuaccauggccgacaccagcgugggcaucgucgggcugcuccuuacaacugcuauggcagccgagguuacgagaaggggauccgcguacuauauguaccuggaucggaacgacgcuggugaagccauuucuuuccccaccacauugggcaugaauaagugcuauauacagaucauggauuuagggcacaugugugacgcaacuaugucauacgagugcccuaugcuggaugaaggaguggagccagacgauguagacuguuggugcaacaccacaaguaccuggguggucuauggcacuugucaucacaaaaagggugaagcccgccgaagccguagagcugugacacuaccgucccauucuaccaggaaacuccaaacgcggucgcagacuuggcuggagucacgcgaguacaccaagcaccuuauuagaguugaaaauuggaucuuuaggaaccccggguucgcacuggccgcugccgcgauugcaugguugcucggaagcaguacaucccagaaagugaucuaucuggucaugauacugcucaucgccccugcuuacucuauucggugcaucggcgugagcaaucgcgauuuuguagagggcauguccgggggaacuuggguugacauuguguuagaacaugguggcugugucaccgugauggcccaggauaagccaacaguggacaucgagcuggucaccacgacuguuucaaacauggcagaggugcgaaguuacugcuaugaagcuagcauaucugauauggccuccgacucaagaugucccacacaaggggaggcguaccuugacaagcagagcgauacccaguauguaugcaaaaggacuuugguggaccggggauggggcaaugguugugggcuguucggaaagggcagucuagucacaugcgccaaauuugcaugcucuaagaaaaugaccggcaaguccauucagccugaaaaccucgaguaccguaucaugcugagcgugcacgggucgcaacacucuggaaugauuguuaaugauacgggucaugaaaccgacgagaaccgcgcuaagguggagaucacaccaaauucccccagagccgaagcuacucuuggcggguucggaucacugggcuuggauugugagccuaggaccggucucgacuuuagugaucuguauuacuuaacaaugaacaauaaacacuggcugguccauaaggaaugguuccacgacaucccacucccguggcacgccggggcagauacuggcacaccccauuggaacaauaaagaggcccuuguggaauuuaaggacgcucacgcgaaacggcagaccguaguugugcugggaagccaggagggcgcaguccauaccgccuuggcuggggcccuagaggcagaaauggauggagccaagggucgacuguccucuggccaccucaaaugccgccugaagauggacaaacuuagacugaagggggugagcuauucauuguguacugcugccuucacguuuacaaagauuccugcagagacccuccauggaacugucaccguggaaguucaguacgcgggcacagacgguccaugcaaagugcccgcucaaauggccguagauaugcagacccugacuccugucgggagguuaauaacagcaaacccagugaucacggagaguaccgaaaacuccaagaugaugcuggagcuagaucccccguucggcgacagcuacauuguuaucggagugggcgagaaaaagauaacucaccacuggcaucggucugggucaacaauuggaaaggccuuugaagcuaccguccgcggugccaaaagaauggcagugcucggcgacacagcuugggauuucgggaguguaggaggcgcccugaauagccuugguaaggggauccaccagaucuucggcgcggccuuuaaauccuuguucggaggcaugucuugguuuucgcaaauucugaucgggacucuccugauguggcuuggacugaacaccaagaauggcagcauuuccuugaugugucucgcucugggugggguguuaauauuccugucaacggcaguuagugccgacgucggaugcucuguggauuuuagcaaaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8298 - RNA, 2323 nt, Artificial Sequence
  ZIKV prME variant mRNA Design 3 opt
gggagaaagcuuaccauggacaccagcgugggcaucgucgggcugcuccuuacaacugccauggcugcagagguuacgagaaggggauccgccuacuauauguaccuggaucggaacgacgcgggugaagcuauuucuuuccccaccacauugggcaugaauaagugcuauauacagaucauggauuuagggcacaugugugacgccacuaugucauacgagugcccuaugcuggaugaaggaguggagccagacgauguagacuguuggugcaacaccacaaguaccuggguggucuauggcacuugucaucacaaaaagggugaagcacgccgaagccguagagccgugacacuaccgucccauucuaccaggaaacuccaaacgcggucgcagacuuggcuggagucacgcgaguacaccaagcaccuuauuagaguugaaaauuggaucuuuaggaaccccggguucgcucuggcagccgcugccauugcgugguugcucggaagcaguacaucccagaaagugaucuaucuggucaugauacugcucaucgcacccgccuacucuauucggugcaucggcgugagcaaucgcgauuuuguagagggcauguccgggggaacuuggguugacauuguguuagaacaugguggcugugucaccgugauggcucaggauaagccaacaguggacaucgagcuggucaccacgacuguuucaaacauggccgaggugcgaaguuacugcuaugaagcaagcauaucugauauggcuuccgacucaagaugucccacacaaggggaggccuaccuugacaagcagagcgauacccaguauguaugcaaaaggacuuugguggaccggggauggggcaaugguugugggcuguucggaaagggcagucuagucacaugcgcgaaauuugccugcucuaagaaaaugaccggcaaguccauucagccugaaaaccucgaguaccguaucaugcugagcgugcacgggucgcaacacucuggaaugauuguuaaugauacgggucaugaaaccgacgagaaccgcgcaaagguggagaucacaccaaauucccccagagcugaagccacucuuggcggguucggaucacugggcuuggauugugagccuaggaccggucucgacuuuagugaucuguauuacuuaacaaugaacaauaaacacuggcugguccauaaggaaugguuccacgacaucccacucccguggcacgcuggggccgauacuggcaccccucauuggaacaauaaagaggcacuuguggaauuuaaggacgcccacgcuaaacggcagacaguaguugugcugggaagccaggagggcgcgguccauaccgcauuggccggggcucuagaggccgaaauggauggagcaaagggucgacuguccucuggccaccucaaaugccgccugaagauggacaaacuuagacugaagggggugagcuauucauuguguacugccgcuuucacguuuacaaagauuccugccgagacccuccauggaacugucaccguggaaguucaguacgcaggcacagacgguccaugcaaagugcccgcgcaaauggcuguagauaugcagacccugacuccugucgggagguuaauaacagccaacccagugaucacggagaguaccgaaaacuccaagaugaugcuggagcuagaucccccguucggcgacagcuacauuguuaucggagugggcgagaaaaagauaacucaccacuggcaucggucugggucaacaauuggaaaggcauuugaagccaccguccgcggugcuaaaagaauggccgugcucggcgacacagcaugggauuucgggaguguaggaggcgcucugaauagccuugguaaggggauccaccagaucuucggcgccgcguuuaaauccuuguucggaggcaugucuugguuuucgcaaauucugaucgggacucuccugauguggcuuggacugaacaccaagaauggcagcauuuccuugaugugucucgcccugggugggguguuaauauuccugucaacggcuguuagugcagacgucggaugcucuguggauuuuagcaaaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8299 - RNA, 2320 nt, Artificial Sequence
  ZIKV prME variant mRNA Design 3 opt
gggagaaagcuuaccaugaccagcgugggcaucgucgggcugcuccuuacaacugccauggcugcagagguuacgagaaggggauccgccuacuauauguaccuggaccggaacgaugcgggugaagcuauuucuuuccccaccacauugggcaugaauaagugcuauauacagaucauggacuuagggcacaugugugaugccacuaugucauacgagugcccuaugcuggacgaaggaguggagccagaugacguagauuguuggugcaacaccacaaguaccuggguggucuauggcacuugucaucacaaaaagggugaagcacgccgaagccguagagccgugacacuaccgucccauucuaccaggaaacuccaaacgcggucgcagacuuggcuggagucacgcgaguacaccaagcaccuuauuagaguugaaaauuggaucuuuaggaaccccggguucgcucuggcagccgcugccauugcgugguugcucggaagcaguacaucccagaaagugaucuaucuggucaugauacugcucaucgcacccgccuacucuauucggugcaucggcgugagcaaucgcgacuuuguagagggcauguccgggggaacuuggguugauauuguguuagaacaugguggcugugucaccgugauggcucaggacaagccaacaguggauaucgagcuggucaccacgacuguuucaaacauggccgaggugcgaaguuacugcuaugaagcaagcauaucugacauggcuuccgauucaagaugucccacacaaggggaggccuaccuugacaagcagagcgacacccaguauguaugcaaaaggacuuugguggaucggggauggggcaaugguugugggcuguucggaaagggcagucuagucacaugcgcgaaauuugccugcucuaagaaaaugaccggcaaguccauucagccugaaaaccucgaguaccguaucaugcugagcgugcacgggucgcaacacucuggaaugauuguuaaugacacgggucaugaaaccgaugagaaccgcgcaaagguggagaucacaccaaauucccccagagcugaagccacucuuggcggguucggaucacugggcuuggacugugagccuaggaccggucucgauuuuagugaccuguauuacuuaacaaugaacaauaaacacuggcugguccauaaggaaugguuccacgauaucccacucccguggcacgcuggggccgacacuggcaccccucauuggaacaauaaagaggcacuuguggaauuuaaggaugcccacgcuaaacggcagacaguaguugugcugggaagccaggagggcgcgguccauaccgcauuggccggggcucuagaggccgaaauggacggagcaaagggucgacuguccucuggccaccucaaaugccgccugaagauggauaaacuuagacugaagggggugagcuauucauuguguacugccgcuuucacguuuacaaagauuccugccgagacccuccauggaacugucaccguggaaguucaguacgcaggcacagacgguccaugcaaagugcccgcgcaaauggcuguagacaugcagacccugacuccugucgggagguuaauaacagccaacccagugaucacggagaguaccgaaaacuccaagaugaugcuggagcuagaucccccguucggcgacagcuacauuguuaucggagugggcgagaaaaagauaacucaccacuggcaucggucugggucaacaauuggaaaggcauuugaagccaccguccgcggugcuaaaagaauggccgugcucggcgauacagcaugggacuucgggaguguaggaggcgcucugaauagccuugguaaggggauccaccagaucuucggcgccgcguuuaaauccuuguucggaggcaugucuugguuuucgcaaauucugaucgggacucuccugauguggcuuggacugaacaccaagaauggcagcauuuccuugaugugucucgcccugggugggguguuaauauuccugucaacggcuguuagugcagaugucggaugcucuguggacuuuagcaaaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8300 - RNA, 2320 nt, Artificial Sequence
  ZIKV prME variant mRNA Design 3 opt
gggagaaagcuuaccaugaccagcgugggcaucgucgggcugcuccuuacaacugccauggcugcagccguuacgagaaggggauccgcguacuauauguaccuggaccggaacgaugcuggugaggccauuucuuuccccaccacauugggcaugaauaagugcuauauacagaucauggacuuagggcacaugugugaugcaacuaugucauacgaaugcccuaugcuggacgagggaguggaaccagaugacguagauuguuggugcaacaccacaaguaccuggguggucuauggcacuugucaucacaaaaagggugaggcccgccgaagccguagagcugugacacuaccgucccauucuaccaggaaacuccaaacgcggucgcagacuuggcuggaaucacgcgaguacaccaagcaccuuauuagaguugagaauuggaucuuuaggaaccccggguucgcacuggccgcugccgcgauugcaugguugcucggaagcaguacaucccagaaagugaucuaucuggucaugauacugcucaucgccccugcuuacucuauucggugcaucggcgugagcaaucgcgacuuuguagaaggcauguccgggggaacuuggguugauauuguguuagagcaugguggcugugucaccgugauggcccaggacaagccaacaguggauaucgaacuggucaccacgacuguuucaaacauggcagaggugcgaaguuacugcuaugaggcuagcauaucugacauggccuccgauucaagaugucccacacaaggggaagcguaccuugacaagcagagcgacacccaguauguaugcaaaaggacuuugguggaucggggauggggcaaugguugugggcuguucggaaagggcagucuagucacaugcgccaaauuugcaugcucuaagaaaaugaccggcaaguccauucagccugagaaccucgaauaccguaucaugcugagcgugcacgggucgcaacacucuggaaugauuguuaaugacacgggucaugagaccgaugaaaaccgcgcuaagguggagaucacaccaaauucccccagagccgaggcuacucuuggcggguucggaucacugggcuuggacugugaaccuaggaccggucucgauuuuagugaccuguauuacuuaacaaugaacaauaaacacuggcugguccauaaggagugguuccacgauaucccacucccguggcacgccggggcagacacuggcacaccccauuggaacaauaaagaagcccuuguggaguuuaaggaugcucacgcgaaacggcagaccguaguugugcugggaagccaggaaggcgcaguccauaccgccuuggcuggggcccuagaggcagagauggacggagccaagggucgacuguccucuggccaccucaaaugccgccugaagauggauaaacuuagacugaagggggugagcuauucauuguguacugcugccuucacguuuacaaagauuccugcagaaacccuccauggaacugucaccguggagguucaguacgcgggcacagacgguccaugcaaagugcccgcucaaauggccguagacaugcagacccugacuccugucgggagguuaauaacagcaaacccagugaucacggaaaguaccgagaacuccaagaugaugcuggaacuagaucccccguucggcgacagcuacauuguuaucggagugggcgagaaaaagauaacucaccacuggcaucggucugggucaacaauuggaaaggccuuugaggcuaccguccgcggugccaaaagaauggcagugcucggcgauacagcuugggacuucgggaguguaggaggcgcccugaauagccuugguaaggggauccaccagaucuucggcgcggccuuuaaauccuuguucggaggcaugucuugguuuucgcaaauucugaucgggacucuccugauguggcuuggacugaacaccaagaauggcagcauuuccuugaugugucucgcucugggugggguguuaauauuccugucaacggcaguuagugccgaugucggaugcucuguggacuuuagcaaaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8301 - RNA, 2332 nt, Artificial Sequence
  ZIKV prME variant mRNA Design 3 opt
gggagaaagcuuaccaugagaggcgccgacaccagcguggggaucgucggacugcuccuuacaacugcuauggcagccgcgguuacgaggcgggguuccgcuuacuauauguaccuggaucgcaacgacgccggcgaggcaauuucuuuccccaccacauuggggaugaauaagugcuauauacagaucauggauuuaggacacaugugugacgccacuaugucauacgaaugcccuaugcuggaugagggcguggaaccagacgauguagacuguuggugcaacaccacaaguaccuggguggucuaugguacuugucaucacaaaaagggggaggcucgacguagcagaagggcagugacacuaccgucccauucuacccggaaacuccaaacgcgcucgcagacuuggcuggaaucaagagaguacaccaagcaccuuauuaggguugagaauuggaucuuucggaaccccggauucgcccuggcugccgcggcaauugccugguugcucggcagcaguacaucccagaaagugaucuaucuggucaugauacugcucaucgcuccugccuacucuauucgcugcaucggcgugagcaaucgagauuuuguagaagggauguccggagguacuuggguugacauuguguuagagcauggcgggugugucaccgugauggcacaggauaagccaacaguggacaucgaacuggucaccacgacuguuucaaacauggcugaggugagaaguuacugcuaugaggccagcauaucugauauggcguccgacucaaggugucccacacaaggagaagccuaccuugacaagcagagcgauacccaguauguaugcaaacggacuuugguggaccguggcugggguaauggguguggacuguucggcaagggcagucuagucacaugcgcaaaauuugcuugcucuaagaaaaugaccgggaaguccauucagccugagaaccucgaauaccgcaucaugcugagcgugcacggaucgcaacacucugguaugauuguuaaugauacgggccaugagaccgacgaaaacagagccaagguggagaucacaccaaauucccccagggcugaggccacucuugggggauucggcucacuggguuuggauugugaaccucggaccgggcucgacuuuagugaucuguauuacuuaacaaugaacaauaaacacuggcugguccauaaggagugguuccacgacaucccacucccguggcacgcaggcgccgauacuggaacaccccauuggaacaauaaagaagcucuuguggaguuuaaggacgcgcacgcaaaacgacagaccguaguugugcugggcagccaggaaggggccguccauaccgcuuuggccggagcacuagaggccgagauggauggugcuaagggccgccuguccucugggcaccucaaaugcagacugaagauggacaagcugaggcugaaaggagugagcuauucauuguguacugccgcauucacguuuacaaagauuccugcggaaacccuccauggcacugucaccguggagguucaguacgcugguacagacgggccaugcaaagugcccgcccaaauggcaguagauaugcagacccugacuccugucggccgguuaauaacagccaacccagugaucacggaaaguaccgagaacuccaagaugaugcuggaacuagaucccccguucggagacagcuacauuguuaucggcgugggggagaaaaagauaacucaccacuggcaucgcucuggaucaacaauugguaaggcuuuugaggccaccgucagaggcgcaaaaaggauggcugugcucggggacacagccugggauuucggaaguguaggcggugcgcugaauagccuugggaagggcauccaccagaucuucggagccgcuuuuaaauccuuguucggcgggaugucuugguuuucgcaaauucugaucggaacucuccugauguggcuuggccugaacaccaagaaugguagcauuuccuugaugugucucgcacuugggggaguguuaauauuccugucaacggccguuagugcugacgucggcugcucuguggauuuuagcaaaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8302 - RNA, 2356 nt, Artificial Sequence
  ZIKV prME variant mRNA Design 3 opt
gggagaaagcuuaccaugagaggccugagcuccaggaagcggcgcucucacgacgugcucaccguccaguuccuuauccuggggauguuguuaaugacaggagguguuacucgacguggcucagccuacuauauguaccuggauagaaacgacgcuggggaggcaauuaguuuucccacgacccuaggaaugaauaaaugcuauauacaaaucauggaucucggccauaugugugacgccacaaugagcuacgaaugcccuaugcuggaugaggguguggaaccagacgauguagacuguuggugcaacacuaccuccacauggguggucuaugggaccugucaccauaagaaaggagaggcgaggcggucucgcagagcugugacucuuccgucgcacucaacaaggaagcugcagacccggagccagacgugguuggaaagucgcgaguacacuaaacaucucauucgaguugagaauuggaucuucagaaaccccggcuuugcccuggcagccgcugcaauugccuggcugcucggcuccucuaccagccagaaggugaucuauuuagucaugauacugcuuaucgcuccugccuacuccauuaggugcaucggggugucaaaucgggauuucguagaaggaaugagugguggcacauggguugacauuguguuggagcacgggggaugugucacugugauggcgcaagauaagccaaccguggacaucgaacuggucacaaccacgguuagcaacauggcagaggugcguucuuacugcuaugaggccuccauaucagauauggcuagcgacagucgcugucccacucagggcgaagccuaccuagacaaacagucugauacacaguauguaugcaagagaacccucguggacagggguugggggaauggauguggccuguuuggcaaagggucccuugucacuugcgcaaaguucgcuugcagcaaaaagaugacaggaaagucgauucaaccugagaaccuggaauaccggaucauguugucugugcacgguucccagcauucaggcaugauuguuaaugauaccgggcacgagacggacgaaaaccgagccaaaguggagaucaccccaaauaguccccgcgcggaggccacacucggaggcuuugguagccugggguuagauugugaaccuagaacuggccuggacuucuccgaucucuauuaccuuaccaugaacaauaagcauuggcugguccacaaagagugguuucacgacaucccauugccguggcaugcaggagcugauacaggcacuccccacuggaacaauaaggaagcccuaguggaguucaaagacgcucaugccaagaggcagaccguaguugugcuggggucucaggaaggagcaguccacacagcccucgcuggugcgcuggaggcagagauggauggcgccaaagggcggcuuagcucaggacaucugaagugccgcuugaagauggacaaacucagacugaagggcgugaguuauuccuuauguaccgcugccuuuacuuucacgaaaauuccugcagaaacacugcacgguaccgucacuguggagguucaauacgccgggaccgacggcccaugcaaggugcccgcucagauggccguagauaugcagacacuaaccccugucggaaggcucauaacugcaaacccagugaucacagaaagcacggagaacucuaaaaugaugcuggaacuugaucccccguuuggcgacucauacauuguuaucggggugggagagaagaagauaacccaccauuggcaccguagugguagcacuauuggcaaagcguucgaggcuacaguccgaggggccaagcggauggcaguguugggagacaccgccugggauuucggcuccguagguggggcucucaauucucugggcaaaggaauccaucaaaucuuuggcgccgcauucaagucgcuguuugggggaaugagcugguucucccagauucuuaucggcacacuguugauguggcucggucugaacacuaaaaaugggucaauuaguuuaaugugucuggcucuaggaggcgugcucauauuucugucuaccgccguuagcgcggacgucgguugcuccguggauuucucaaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8303 - RNA, 2356 nt, Artificial Sequence
  ZIKV prME variant mRNA Design 3 opt
gggagaaagcuuaccaugagaggccugagcuccaggaagcggcgcucucacgacgugcucaccguccaguuccuuauccuggggauguuguuaaugacaggagccguuacucgacgugguucagcuuacuauauguaccuggauagaaacgacgcaggcgaggccauuaguuuucccacgacccuagggaugaauaaaugcuauauacaaaucauggaucucggacauaugugugacgcgacaaugagcuacgaaugcccuaugcuggaugagggcguggaaccagacgauguagacuguuggugcaacacuaccuccacauggguggucuaugguaccugucaccauaagaaaggggaggcuaggcggucucgcagagccgugacucuuccgucgcacucaacaaggaagcugcagacccggagccagacgugguuggaaagucgcgaguacacuaaacaucucauucgaguugagaauuggaucuucagaaaccccggauuugcacuggccgcugcagccauugcuuggcugcucggcuccucuaccagccagaaggugaucuauuuagucaugauacugcuuaucgccccugcguacuccauuaggugcaucggcgugucaaaucgggauuucguagaagggaugaguggagguacauggguugacauuguguuggagcacggcgggugugucacugugauggcacaagauaagccaaccguggacaucgaacuggucacaaccacgguuagcaacauggccgaggugcguucuuacugcuaugaggcuuccauaucagauauggccagcgacagucgcugucccacucagggagaagcauaccuagacaaacagucugauacacaguauguaugcaagagaacccucguggacaggggcugggguaauggguguggacuguuuggcaaaggcucccuugucacuugcgcuaaguucgccugcagcaaaaagaugacagggaagucgauucaaccugagaaccuggaauaccggaucauguugucugugcacggaucccagcauucagguaugauuguuaaugauaccggccacgagacggacgaaaaccgagcgaaaguggagaucaccccaaauaguccccgcgccgaggcaacacucgggggauuuggcagccuggguuuagauugugaaccuagaacugggcuggacuucuccgaucucuauuaccuuaccaugaacaauaagcauuggcugguccacaaagagugguuucacgacaucccauugccguggcaugcuggcgccgauacaggaacuccccacuggaacaauaaggaagcucuaguggaguucaaagacgcccaugcaaagaggcagaccguaguugugcugggcucucaggaaggggccguccacacagcucucgcgggagcacuggaggccgagauggauggugcuaaaggccggcuuagcucagggcaucugaagugccgcuugaagauggacaaacucagacugaagggagugaguuauuccuuauguaccgccgcauuuacuuucacgaaaauuccugccgaaacacugcacggcaccgucacuguggagguucaauacgcugguaccgacgggccaugcaaggugcccgcccagauggcaguagauaugcagacacuaaccccugucggcaggcucauaacugcgaacccagugaucacagaaagcacggagaacucuaaaaugaugcuggaacuugaucccccguuuggagacucauacauuguuaucggcgugggggagaagaagauaacccaccauuggcaccguaguggaagcacuauugguaaggcuuucgaggccacaguccggggcgcaaaacgaauggccguguugggggacaccgcuugggauuucggauccguaggcggugcccucaauucucuggggaaaggcauccaucaaaucuuuggagcagcuuucaagucgcuguuuggcgggaugagcugguucucccagauucuuaucggaacacuguugauguggcucggccugaacacuaaaaaugguucaauuaguuuaaugugucuggcccuagggggagugcucauauuucugucuaccgcgguuagcgccgacgucggcugcuccguggauuucucaaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8304 - RNA, 2347 nt, Artificial Sequence
  ZIKV prME variant mRNA Design 3 opt
gggagaaagcuuaccaugagaaucauuaacgccaggaaggagaaaaagcggcgcggcgcugacaccagcguggggauagucggacugcuccuuacaacugcaauggccgcggaaguuacgcgacgugguuccgcuuacuauauguaccuggauagaaaugacgccggcgaggcaaucucuuuccccaccacauuggggaugaacaaaugcuauauucagaucauggauuuaggacacaugugugacgccacuaugucauacgaaugcccuaugcuggaugagggcguggaaccagacgauguagacuguuggugcaauaccacaaguaccuggguggucuaugguacuugucaucacaagaaaggggaggcuaggcggagccgcagagcagugacacuaccgucccauucuaccaggaagcuccaaacgcggucgcagacuuggcuggagucacgcgaauacaccaagcaccuuauucgaguugagaacuggaucuuuagaaaucccggauucgcccuggcugccgcggcaauagccugguugcucggcagcaguacaucccagaaagugaucuaucuggucaugauucugcucaucgcuccugccuacucuauuaggugcaucggcgugagcaaccgggauuuuguagaagggauguccggagguacuuggguugacauaguguuagagcauggcgggugugucaccgugauggcacaggauaagccaacaguggacauugagcuggucaccacgacuguuucaaauauggcugaagugcguaguuacugcuaugaggccagcaucucugauauggcguccgacucacgcugucccacacaaggagaagccuaccuugacaaacagagcgauacccaguauguaugcaagagaacuuugguggacaggggcugggguaacggguguggacuguucggcaaaggcagucuagucacaugcgcaaaguuugcuugcucuaagaaaaugaccgggaaguccauucagccugagaaucucgaauaccggaucaugcugagcgugcacggaucgcaacacucugguaugaucguuaacgauacgggccaugagaccgacgagaaucgagccaaaguggaaauuacaccaaacucaccccgcgcugaggccacucuugggggauucggcucccuggguuuggauugugaaccuagaaccgggcucgacuuuagugaucuguauuacuuaacaaugaauaacaagcacuggcugguccauaaagagugguuccacgacauaccacucccguggcacgcaggcgccgauacuggaacaccccauuggaauaacaaggaagcucuuguggaguuuaaagacgcgcacgcaaagaggcagaccguaguugugcugggcagccaggagggggccguccauaccgcuuuggccggagcacuagaagccgagauggauggugcuaagggccggcuguccucugggcaccucaaaugccgccugaagauggacaaacuuagacugaagggagugagcuauucauuguguacugccgcauucacguuuacaaaaaucccugcggaaacccuccauggcacugucaccguggagguucaguacgcugguacagacgggccaugcaaggugcccgcccaaauggcaguagauaugcagacccugacuccugucggcagguuaauuacagccaacccagugaucacggaaaguaccgaaaauuccaagaugaugcuggagcuagaucccccguucggagacagcuacauaguuauuggcgugggggagaaaaagaucacucaccacuggcaucguucuggaucaacaaucgguaaggcuuuugaggccaccguccggggcgcaaaacgaauggcugugcucggggacacagccugggauuucggaaguguaggcggugcgcugaacagccuugggaaaggcauucaccagaucuucggagccgcuuuuaaguccuuguucggcgggaugucuugguuuucgcaaauucugauaggaacucuccugauguggcuuggccugaauaccaagaacgguagcaucuccuugaugugucucgcauuagggggagugcugauuuuccugucaacggccguuagugcugacgucggcugcugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8305 - RNA, 2344 nt, Artificial Sequence
  ZIKV prME variant mRNA Design 3 opt
gggagaaagcuuaccaugaucauuaacgccagaaaggagaaaaagaggcggggcgcugacaccagcguggggauagucggacugcuccuuacaacugcaauggccgcggaaguuacgcgccgagguuccgcuuacuauauguaccuggaucguaaugacgccggcgaggcaaucucuuuccccaccacauuggggaugaacaaaugcuauauucagaucauggauuuaggacacaugugugacgccacuaugucauacgaaugcccuaugcuggaugagggcguggaaccagacgauguagacuguuggugcaauaccacaaguaccuggguggucuaugguacuugucaucacaagaaaggggaggcuagaaggagccggcgcgcagugacacuaccgucccauucuaccagaaagcuccaaacgaggucgcagacuuggcuggagucacgggaauacaccaagcaccuuauucgcguugagaacuggaucuuucgaaaucccggauucgcccuggcugccgcggcaauagccugguugcucggcagcaguacaucccagaaagugaucuaucuggucaugauucugcucaucgcuccugccuacucuauuagaugcaucggcgugagcaacagggauuuuguagaagggauguccggagguacuuggguugacauaguguuagagcauggcgggugugucaccgugauggcacaggauaagccaacaguggacauugagcuggucaccacgacuguuucaaauauggcugaagugcggaguuacugcuaugaggccagcaucucugauauggcguccgacucacguugucccacacaaggagaagccuaccuugacaaacagagcgauacccaguauguaugcaagcgcacuuugguggacagaggcugggguaacggguguggacuguucggcaaaggcagucuagucacaugcgcaaaguuugcuugcucuaagaaaaugaccgggaaguccauucagccugagaaucucgaauacaggaucaugcugagcgugcacggaucgcaacacucugguaugaucguuaacgauacgggccaugagaccgacgagaaucgggccaaaguggaaauuacaccaaacucaccccgagcugaggccacucuugggggauucggcucccuggguuuggauugugaaccucgcaccgggcucgacuuuagugaucuguauuacuuaacaaugaauaacaagcacuggcugguccauaaagagugguuccacgacauaccacucccguggcacgcaggcgccgauacuggaacaccccauuggaauaacaaggaagcucuuguggaguuuaaagacgcgcacgcaaagagacagaccguaguugugcugggcagccaggagggggccguccauaccgcuuuggccggagcacuagaagccgagauggauggugcuaagggcaggcuguccucugggcaccucaaaugccggcugaagauggacaaacuucgccugaagggagugagcuauucauuguguacugccgcauucacguuuacaaaaaucccugcggaaacccuccauggcacugucaccguggagguucaguacgcugguacagacgggccaugcaaggugcccgcccaaauggcaguagauaugcagacccugacuccugucggcagauuaauuacagccaacccagugaucacggaaaguaccgaaaauuccaagaugaugcuggagcuagaucccccguucggagacagcuacauaguuauuggcgugggggagaaaaagaucacucaccacuggcauaggucuggaucaacaaucgguaaggcuuuugaggccaccguccguggcgcaaaacggauggcugugcucggggacacagccugggauuucggaaguguaggcggugcgcugaacagccuugggaaaggcauucaccagaucuucggagccgcuuuuaaguccuuguucggcgggaugucuugguuuucgcaaauucugauaggaacucuccugauguggcuuggccugaauaccaagaacgguagcaucuccuugaugugucucgcauuagggggagugcugauuuuccugucaacggccguuagugcugacgucggcugcugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8306 - RNA, 2341 nt, Artificial Sequence
  ZIKV prME variant mRNA Design 3 opt
gggagaaagcuuaccaugaucaacgccagaaaggagaaaaagaggcggggcgcugacaccagcguggggauugucggacugcuccuuacaacugcaauggccgcggaaguuacgcgccgagguuccgcuuacuauauguaccuggaucguaaugacgccggcgaggcaauaucuuuccccaccacauuggggaugaacaaaugcuauauccagauuauggauuuaggacacaugugugacgccacuaugucauacgaaugcccuaugcuggaugagggcguggaaccagacgauguagacuguuggugcaauaccacaaguaccuggguggucuaugguacuugucaucacaagaaaggggaggcuagaaggagccggcgcgcagugacacuaccgucccauucuaccagaaagcuccaaacgaggucgcagacuuggcuggagucacgggaauacaccaagcaccuuauccgcguugagaacuggauuuuucgaaaucccggauucgcccuggcugccgcggcaaucgccugguugcucggcagcaguacaucccagaaagugauauaucuggucaugauccugcucauugcuccugccuacucuaucagaugcauuggcgugagcaacagggauuuuguagaagggauguccggagguacuuggguugacaucguguuagagcauggcgggugugucaccgugauggcacaggauaagccaacaguggacauagagcuggucaccacgacuguuucaaauauggcugaagugcggaguuacugcuaugaggccagcauuucugauauggcguccgacucacguugucccacacaaggagaagccuaccuugacaaacagagcgauacccaguauguaugcaagcgcacuuugguggacagaggcugggguaacggguguggacuguucggcaaaggcagucuagucacaugcgcaaaguuugcuugcucuaagaaaaugaccgggaaguccauccagccugagaaucucgaauacaggauuaugcugagcgugcacggaucgcaacacucugguaugaucguuaacgauacgggccaugagaccgacgagaaucgggccaaaguggaaaucacaccaaacucaccccgagcugaggccacucuugggggauucggcucccuggguuuggauugugaaccucgcaccgggcucgacuuuagugaucuguauuacuuaacaaugaauaacaagcacuggcugguccauaaagagugguuccacgacauuccacucccguggcacgcaggcgccgauacuggaacaccccauuggaauaacaaggaagcucuuguggaguuuaaagacgcgcacgcaaagagacagaccguaguugugcugggcagccaggagggggccguccauaccgcuuuggccggagcacuagaagccgagauggauggugcuaagggcaggcuguccucugggcaccucaaaugccggcugaagauggacaaacuucgccugaagggagugagcuauucauuguguacugccgcauucacguuuacaaaaauaccugcggaaacccuccauggcacugucaccguggagguucaguacgcugguacagacgggccaugcaaggugcccgcccaaauggcaguagauaugcagacccugacuccugucggcagauuaaucacagccaacccagugauuacggaaaguaccgaaaauuccaagaugaugcuggagcuagaucccccguucggagacagcuacaucguuauaggcgugggggagaaaaagauuacucaccacuggcauaggucuggaucaacaaucgguaaggcuuuugaggccaccguccguggcgcaaaacggauggcugugcucggggacacagccugggauuucggaaguguaggcggugcgcugaacagccuugggaaaggcauccaccagauuuucggagccgcuuuuaaguccuuguucggcgggaugucuugguuuucgcaaauccugauuggaacucuccugauguggcuuggccugaauaccaagaacgguagcauauccuugaugugucucgcauuagggggagugcugaucuuccugucaacggccguuagugcugacgucggcugcugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8307 - RNA, 2338 nt, Artificial Sequence
  ZIKV prME variant mRNA Design 3 opt
gggagaaagcuuaccaugaacgccagaaaggagaaaaagaggcggggcgcugacaccagcguggggaucgucggacugcuccuuacaacugcaauggccgcggaaguuacgcgccgagguuccgcuuacuauauguaccuggaucguaaugacgccggcgaggcaauuucuuuccccaccacauuggggaugaacaaaugcuauauacagaucauggauuuaggacacaugugugacgccacuaugucauacgaaugcccuaugcuggaugagggcguggaaccagacgauguagacuguuggugcaauaccacaaguaccuggguggucuaugguacuugucaucacaagaaaggggaggcuagaaggagccggcgcgcagugacacuaccgucccauucuaccagaaagcuccaaacgaggucgcagacuuggcuggagucacgggaauacaccaagcaccuuauucgcguugagaacuggaucuuucgaaaucccggauucgcccuggcugccgcggcaauugccugguugcucggcagcaguacaucccagaaagugaucuaucuggucaugauacugcucaucgcuccugccuacucuauuagaugcaucggcgugagcaacagggauuuuguagaagggauguccggagguacuuggguugacauuguguuagagcauggcgggugugucaccgugauggcacaggauaagccaacaguggacaucgagcuggucaccacgacuguuucaaauauggcugaagugcggaguuacugcuaugaggccagcauaucugauauggcguccgacucacguugucccacacaaggagaagccuaccuugacaaacagagcgauacccaguauguaugcaagcgcacuuugguggacagaggcugggguaacggguguggacuguucggcaaaggcagucuagucacaugcgcaaaguuugcuugcucuaagaaaaugaccgggaaguccauucagccugagaaucucgaauacaggaucaugcugagcgugcacggaucgcaacacucugguaugauuguuaacgauacgggccaugagaccgacgagaaucgggccaaaguggaaaucacaccaaacucaccccgagcugaggccacucuugggggauucggcucccuggguuuggauugugaaccucgcaccgggcucgacuuuagugaucuguauuacuuaacaaugaauaacaagcacuggcugguccauaaagagugguuccacgacaucccacucccguggcacgcaggcgccgauacuggaacaccccauuggaauaacaaggaagcucuuguggaguuuaaagacgcgcacgcaaagagacagaccguaguugugcugggcagccaggagggggccguccauaccgcuuuggccggagcacuagaagccgagauggauggugcuaagggcaggcuguccucugggcaccucaaaugccggcugaagauggacaaacuucgccugaagggagugagcuauucauuguguacugccgcauucacguuuacaaaaauuccugcggaaacccuccauggcacugucaccguggagguucaguacgcugguacagacgggccaugcaaggugcccgcccaaauggcaguagauaugcagacccugacuccugucggcagauuaauaacagccaacccagugaucacggaaaguaccgaaaauuccaagaugaugcuggagcuagaucccccguucggagacagcuacauuguuaucggcgugggggagaaaaagauaacucaccacuggcauaggucuggaucaacaauugguaaggcuuuugaggccaccguccguggcgcaaaacggauggcugugcucggggacacagccugggauuucggaaguguaggcggugcgcugaacagccuugggaaaggcauccaccagaucuucggagccgcuuuuaaguccuuguucggcgggaugucuugguuuucgcaaauucugaucggaacucuccugauguggcuuggccugaauaccaagaacgguagcauuuccuugaugugucucgcauuagggggagugcugauauuccugucaacggccguuagugcugacgucggcugcugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8308 - RNA, 2335 nt, Artificial Sequence
  ZIKV prME variant mRNA Design 3 opt
gggagaaagcuuaccauggccagaaaggagaaaaagaggcggggcgcugacaccagcguggggaucgucggacugcuccuuacaacugcaauggccgcggaaguuacgcgccgagguuccgcuuacuauauguaccuggaucguaacgacgccggcgaggcaauuucuuuccccaccacauuggggaugaauaaaugcuauauacagaucauggauuuaggacacaugugugacgccacuaugucauacgaaugcccuaugcuggaugagggcguggaaccagacgauguagacuguuggugcaacaccacaaguaccuggguggucuaugguacuugucaucacaagaaaggggaggcuagaaggagccggcgcgcagugacacuaccgucccauucuaccagaaagcuccaaacgaggucgcagacuuggcuggagucacgggaauacaccaagcaccuuauucgcguugagaauuggaucuuucgaaaccccggauucgcccuggcugccgcggcaauugccugguugcucggcagcaguacaucccagaaagugaucuaucuggucaugauacugcucaucgcuccugccuacucuauuagaugcaucggcgugagcaauagggauuuuguagaagggauguccggagguacuuggguugacauuguguuagagcauggcgggugugucaccgugauggcacaggauaagccaacaguggacaucgagcuggucaccacgacuguuucaaacauggcugaagugcggaguuacugcuaugaggccagcauaucugauauggcguccgacucacguugucccacacaaggagaagccuaccuugacaaacagagcgauacccaguauguaugcaagcgcacuuugguggacagaggcugggguaauggguguggacuguucggcaaaggcagucuagucacaugcgcaaaguuugcuugcucuaagaaaaugaccgggaaguccauucagccugagaaccucgaauacaggaucaugcugagcgugcacggaucgcaacacucugguaugauuguuaaugauacgggccaugagaccgacgagaaccgggccaaaguggaaaucacaccaaauucaccccgagcugaggccacucuugggggauucggcucccuggguuuggauugugaaccucgcaccgggcucgacuuuagugaucuguauuacuuaacaaugaacaauaagcacuggcugguccauaaagagugguuccacgacaucccacucccguggcacgcaggcgccgauacuggaacaccccauuggaacaauaaggaagcucuuguggaguuuaaagacgcgcacgcaaagagacagaccguaguugugcugggcagccaggagggggccguccauaccgcuuuggccggagcacuagaagccgagauggauggugcuaagggcaggcuguccucugggcaccucaaaugccggcugaagauggacaaacuucgccugaagggagugagcuauucauuguguacugccgcauucacguuuacaaaaauuccugcggaaacccuccauggcacugucaccguggagguucaguacgcugguacagacgggccaugcaaggugcccgcccaaauggcaguagauaugcagacccugacuccugucggcagauuaauaacagccaacccagugaucacggaaaguaccgagaacuccaagaugaugcuggagcuagaucccccguucggagacagcuacauuguuaucggcgugggggagaaaaagauaacucaccacuggcauaggucuggaucaacaauugguaaggcuuuugaagccaccguccguggcgcaaaacggauggcugugcucggggacacagccugggauuucggaaguguaggcggugcgcugaauagccuugggaaaggcauccaccagaucuucggagccgcuuuuaaguccuuguucggcgggaugucuugguuuucgcaaauucugaucggaacucuccugauguggcuuggccugaacaccaagaaugguagcauuuccuugaugugucucgcauuagggggagugcugauauuccugucaacggccguuagugcugacgucggcugcugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8309 - RNA, 2332 nt, Artificial Sequence
  ZIKV prME variant mRNA Design 3 opt
gggagaaagcuuaccaugagaaaggagaaaaagaggcggggcgccgacaccagcguggggaucgucggacugcuccuuacaacugcuauggcagccgaaguuacgcgccgagguuccgcguacuauauguaccuggaucguaacgacgcuggcgaggccauuucuuuccccaccacauuggggaugaauaaaugcuauauacagaucauggauuuaggacacaugugugacgcaacuaugucauacgaaugcccuaugcuggaugagggcguggaaccagacgauguagacuguuggugcaacaccacaaguaccuggguggucuaugguacuugucaucacaagaaaggggaggccagaaggagccggcgcgcugugacacuaccgucccauucuaccagaaagcuccaaacgaggucgcagacuuggcuggagucacgggaauacaccaagcaccuuauucgcguugagaauuggaucuuucgaaaccccggauucgcacuggccgcugccgcgauugcaugguugcucggcagcaguacaucccagaaagugaucuaucuggucaugauacugcucaucgccccugcuuacucuauuagaugcaucggcgugagcaauagggauuuuguagaagggauguccggagguacuuggguugacauuguguuagagcauggcgggugugucaccgugauggcccaggauaagccaacaguggacaucgagcuggucaccacgacuguuucaaacauggcagaagugcggaguuacugcuaugaggcuagcauaucugauauggccuccgacucacguugucccacacaaggagaagcguaccuugacaaacagagcgauacccaguauguaugcaagcgcacuuugguggacagaggcugggguaauggguguggacuguucggcaaaggcagucuagucacaugcgccaaguuugcaugcucuaagaaaaugaccgggaaguccauucagccugagaaccucgaauacaggaucaugcugagcgugcacggaucgcaacacucugguaugauuguuaaugauacgggccaugagaccgacgagaaccgggcuaaaguggaaaucacaccaaauucaccccgagccgaggcuacucuugggggauucggcucccuggguuuggauugugaaccucgcaccgggcucgacuuuagugaucuguauuacuuaacaaugaacaauaagcacuggcugguccauaaagagugguuccacgacaucccacucccguggcacgccggcgcagauacuggaacaccccauuggaacaauaaggaagcccuuguggaguuuaaagacgcucacgcgaagagacagaccguaguugugcugggcagccaggagggggcaguccauaccgccuuggcuggagcccuagaagcagagauggauggugccaagggcaggcuguccucugggcaccucaaaugccggcugaagauggacaaacuucgccugaagggagugagcuauucauuguguacugcugccuucacguuuacaaaaauuccugcagaaacccuccauggcacugucaccguggagguucaguacgcggguacagacgggccaugcaaggugcccgcucaaauggccguagauaugcagacccugacuccugucggcagauuaauaacagcaaacccagugaucacggaaaguaccgagaacuccaagaugaugcuggagcuagaucccccguucggagacagcuacauuguuaucggcgugggggagaaaaagauaacucaccacuggcauaggucuggaucaacaauugguaaagccuuugaagcuaccguccguggcgccaagcggauggcagugcucggggacacagcuugggauuucggaaguguaggcggugcccugaauagccuugggaaaggcauccaccagaucuucggagcggccuuuaaguccuuguucggcgggaugucuugguuuucgcaaauucugaucggaacucuccugauguggcuuggccugaacaccaagaaugguagcauuuccuugaugugucucgcuuuagggggagugcugauauuccugucaacggcaguuagugccgacgucggcugcugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8310 - RNA, 2329 nt, Artificial Sequence
  ZIKV prME variant mRNA Design 3 opt
gggagaaagcuuaccaugaaggagaaaaagagaaggggcgccgacaccagcguggggaucgucggacugcuccuuacaacugcuauggcagccgaaguuacgcggcgcgguuccgcguacuauauguaccuggaucgaaacgacgcuggcgaggccauuucuuuccccaccacauuggggaugaauaaaugcuauauacagaucauggauuuaggacacaugugugacgcaacuaugucauacgaaugcccuaugcuggaugagggcguggaaccagacgauguagacuguuggugcaacaccacaaguaccuggguggucuaugguacuugucaucacaagaaaggggaggcccguagaagcaggcgggcugugacacuaccgucccauucuacccgcaagcuccaaacgagaucgcagacuuggcuggagucaagggaauacaccaagcaccuuauucggguugagaauuggaucuuucgcaaccccggauucgcacuggccgcugccgcgauugcaugguugcucggcagcaguacaucccagaaagugaucuaucuggucaugauacugcucaucgccccugcuuacucuauucgaugcaucggcgugagcaauagagauuuuguagaagggauguccggagguacuuggguugacauuguguuagagcauggcgggugugucaccgugauggcccaggauaagccaacaguggacaucgagcuggucaccacgacuguuucaaacauggcagaagugaggaguuacugcuaugaggcuagcauaucugauauggccuccgacucacggugucccacacaaggagaagcguaccuugacaaacagagcgauacccaguauguaugcaagcguacuuugguggaccgcggcugggguaauggguguggacuguucggcaaaggcagucuagucacaugcgccaaguuugcaugcucuaagaaaaugaccgggaaguccauucagccugagaaccucgaauacagaaucaugcugagcgugcacggaucgcaacacucugguaugauuguuaaugauacgggccaugagaccgacgagaacagggcuaaaguggaaaucacaccaaauucaccccgggccgaggcuacucuugggggauucggcucccuggguuuggauugugaaccucgaaccgggcucgacuuuagugaucuguauuacuuaacaaugaacaauaagcacuggcugguccauaaagagugguuccacgacaucccacucccguggcacgccggcgcagauacuggaacaccccauuggaacaauaaggaagcccuuguggaguuuaaagacgcucacgcgaagcgccagaccguaguugugcugggcagccaggagggggcaguccauaccgccuuggcuggagcccuagaagcagagauggauggugccaagggcagacuguccucugggcaccucaaaugcaggcugaagauggacaaacuucggcugaagggagugagcuauucauuguguacugcugccuucacguuuacaaaaauuccugcagaaacccuccauggcacugucaccguggagguucaguacgcggguacagacgggccaugcaaggugcccgcucaaauggccguagauaugcagacccugacuccugucggccgcuuaauaacagcaaacccagugaucacggaaaguaccgagaacuccaagaugaugcuggagcuagaucccccguucggagacagcuacauuguuaucggcgugggggagaaaaagauaacucaccacuggcauagaucuggaucaacaauugguaaagccuuugaagcuaccgucaggggcgccaagcguauggcagugcucggggacacagcuugggauuucggaaguguaggcggugcccugaauagccuugggaaaggcauccaccagaucuucggagcggccuuuaaguccuuguucggcgggaugucuugguuuucgcaaauucugaucggaacucuccugauguggcuuggccugaacaccaagaaugguagcauuuccuugaugugucucgcuuuagggggagugcugauauuccugucaacggcaguuagugccgacgucggcugcugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8311 - RNA, 2326 nt, Artificial Sequence
  ZIKV prME variant mRNA Design 3 opt
gggagaaagcuuaccauggagaagaaaagaaggggcgccgacaccagcguggggaucgucggacugcuccuuacaacugcuauggcagccgaaguuacgcggcgcgguuccgcguacuauauguaccuggaucgaaacgacgcuggcgaggccauuucuuuccccaccacauuggggaugaauaagugcuauauacagaucauggauuuaggacacaugugugacgcaacuaugucauacgaaugcccuaugcuggaugagggcguggaaccagacgauguagacuguuggugcaacaccacaaguaccuggguggucuaugguacuugucaucacaaaaagggggaggcccguagaagcaggcgggcugugacacuaccgucccauucuacccgcaaacuccaaacgagaucgcagacuuggcuggagucaagggaauacaccaagcaccuuauucggguugagaauuggaucuuucgcaaccccggauucgcacuggccgcugccgcgauugcaugguugcucggcagcaguacaucccagaaggugaucuaucuggucaugauacugcucaucgccccugcuuacucuauucgaugcaucggcgugagcaauagagauuuuguagaagggauguccggagguacuuggguugacauuguguuagagcauggcgggugugucaccgugauggcccaggauaaaccaacaguggacaucgagcuggucaccacgacuguuucaaacauggcagaagugaggaguuacugcuaugaggcuagcauaucugauauggccuccgacucacggugucccacacaaggagaagcguaccuugacaagcagagcgauacccaguauguaugcaaacguacuuugguggaccgcggcugggguaauggguguggacuguucggcaagggcagucuagucacaugcgccaaauuugcaugcucuaagaagaugaccgggaaauccauucagccugagaaccucgaauacagaaucaugcugagcgugcacggaucgcaacacucugguaugauuguuaaugauacgggccaugagaccgacgagaacagggcuaagguggaaaucacaccaaauucaccccgggccgaggcuacucuugggggauucggcucccuggguuuggauugugaaccucgaaccgggcucgacuuuagugaucuguauuacuuaacaaugaacaauaaacacuggcugguccauaaggagugguuccacgacaucccacucccguggcacgccggcgcagauacuggaacaccccauuggaacaauaaagaagcccuuguggaguuuaaggacgcucacgcgaaacgccagaccguaguugugcugggcagccaggagggggcaguccauaccgccuuggcuggagcccuagaagcagagauggauggugccaagggcagacuguccucugggcaccucaagugcaggcugaaaauggacaagcugcggcugaaaggagugagcuauucauuguguacugcugccuucacguuuacaaagauuccugcagaaacccuccauggcacugucaccguggagguucaguacgcggguacagacgggccaugcaaagugcccgcucaaauggccguagauaugcagacccugacuccugucggccgcuuaauaacagcaaacccagugaucacggaaaguaccgagaacuccaagaugaugcuggagcuagaucccccguucggagacagcuacauuguuaucggcgugggggaaaagaaaauaacucaccacuggcauagaucuggaucaacaauugguaaggccuuugaggcuaccgucaggggcgccaaacguauggcagugcucggggacacagcuugggauuucggaaguguaggcggugcccugaauagccuugggaagggcauccaccagaucuucggagcggccuuuaaauccuuguucggcgggaugucuugguuuucgcaaauucugaucggaacucuccugauguggcuuggccugaacaccaagaaugguagcauuuccuugaugugucucgcucuugggggaguguuaauauuccugucaacggcaguuagugccgacgucggcugcugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8312 - RNA, 2323 nt, Artificial Sequence
  ZIKV prME variant mRNA Design 3 opt
gggagaaagcuuaccaugaagaaaagaaggggcgccgacaccagcguggggaucgucggacugcuccuuacaacugcuauggcagccgagguuacgcggcgcgguuccgcguacuauauguaccuggaucgaaacgacgcuggcgaagccauuucuuuccccaccacauuggggaugaauaagugcuauauacagaucauggauuuaggacacaugugugacgcaacuaugucauacgagugcccuaugcuggaugaaggcguggagccagacgauguagacuguuggugcaacaccacaaguaccuggguggucuaugguacuugucaucacaaaaagggggaagcccguagaagcaggcgggcugugacacuaccgucccauucuacccgcaaacuccaaacgagaucgcagacuuggcuggagucaagggaguacaccaagcaccuuauucggguugaaaauuggaucuuucgcaaccccggauucgcacuggccgcugccgcgauugcaugguugcucggcagcaguacaucccagaaggugaucuaucuggucaugauacugcucaucgccccugcuuacucuauucgaugcaucggcgugagcaauagagauuuuguagaggggauguccggagguacuuggguugacauuguguuagaacauggcgggugugucaccgugauggcccaggauaaaccaacaguggacaucgagcuggucaccacgacuguuucaaacauggcagaggugaggaguuacugcuaugaagcuagcauaucugauauggccuccgacucacggugucccacacaaggagaggcguaccuugacaagcagagcgauacccaguauguaugcaaacguacuuugguggaccgcggcugggguaauggguguggacuguucggcaagggcagucuagucacaugcgccaaauuugcaugcucuaagaagaugaccgggaaauccauucagccugaaaaccucgaguacagaaucaugcugagcgugcacggaucgcaacacucugguaugauuguuaaugauacgggccaugaaaccgacgagaacagggcuaagguggagaucacaccaaauucaccccgggccgaagcuacucuugggggauucggcucccuggguuuggauugugagccucgaaccgggcucgacuuuagugaucuguauuacuuaacaaugaacaauaaacacuggcugguccauaaggaaugguuccacgacaucccacucccguggcacgccggcgcagauacuggaacaccccauuggaacaauaaagaggcccuuguggaauuuaaggacgcucacgcgaaacgccagaccguaguugugcugggcagccaggagggggcaguccauaccgccuuggcuggagcccuagaggcagaaauggauggugccaagggcagacuguccucugggcaccucaagugcaggcugaaaauggacaagcugcggcugaaaggagugagcuauucauuguguacugcugccuucacguuuacaaagauuccugcagagacccuccauggcacugucaccguggaaguucaguacgcggguacagacgggccaugcaaagugcccgcucaaauggccguagauaugcagacccugacuccugucggccgcuuaauaacagcaaacccagugaucacggagaguaccgaaaacuccaagaugaugcuggagcuagaucccccguucggagacagcuacauuguuaucggcgugggggagaagaaaauaacucaccacuggcauagaucuggaucaacaauugguaaggccuuugaagcuaccgucaggggcgccaaacguauggcagugcucggggacacagcuugggauuucggaaguguaggcggugcccugaauagccuugggaagggcauccaccagaucuucggagcggccuuuaaauccuuguucggcgggaugucuugguuuucgcaaauucugaucggaacucuccugauguggcuuggccugaacaccaagaaugguagcauuuccuugaugugucucgcucuugggggaguguuaauauuccugucaacggcaguuagugccgacgucggcugcugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8313 - RNA, 2320 nt, Artificial Sequence
  ZIKV prME variant mRNA Design 3 opt
gggagaaagcuuaccaugaagagaaggggcgccgacaccagcguggggaucgucggacugcuccuuacaacugcuauggcagccgagguuacgcggcgcgguuccgcguacuauauguaccuggaucgaaacgacgcuggcgaagccauuucuuuccccaccacauuggggaugaauaaaugcuauauacagaucauggauuuaggacacaugugugacgcaacuaugucauacgagugcccuaugcuggaugaaggcguggagccagacgauguagacuguuggugcaacaccacaaguaccuggguggucuaugguacuugucaucacaagaaaggggaagcccguagaagcaggcgggcugugacacuaccgucccauucuacccgcaagcuccaaacgagaucgcagacuuggcuggagucaagggaguacaccaaacaccuuauucggguugaaaauuggaucuuucgcaaccccggauucgcacuggccgcugccgcgauugcaugguugcucggcagcaguacaucccagaaggugaucuaucuggucaugauacugcucaucgccccugcuuacucuauucgaugcaucggcgugagcaauagagauuuuguagaggggauguccggagguacuuggguugacauuguguuagaacauggcgggugugucaccgugauggcccaggauaagccaacaguggacaucgagcuggucaccacgacuguuucaaacauggcagaggugaggaguuacugcuaugaagcuagcauaucugauauggccuccgacucacggugucccacacaaggagaggcguaccuugacaaacagagcgauacccaguauguaugcaagcguacuuugguggaccgcggcugggguaauggguguggacuguucggcaaaggcagucuagucacaugcgccaaguuugcaugcucuaaaaagaugaccgggaaguccauucagccugaaaaccucgaguacagaaucaugcugagcgugcacggaucgcaacacucugguaugauuguuaaugauacgggccaugaaaccgacgagaacagggcuaaaguggagaucacaccaaauucaccccgggccgaagcuacucuugggggauucggcucccuggguuuggauugugagccucgaaccgggcucgacuuuagugaucuguauuacuuaacaaugaacaauaagcacuggcugguccauaaagaaugguuccacgacaucccacucccguggcacgccggcgcagauacuggaacaccccauuggaacaauaaggaggcccuuguggaauuuaaagacgcucacgcgaagcgccagaccguaguugugcugggcagccaggagggggcaguccauaccgccuuggcuggagcccuagaggcagaaauggauggugccaaaggcagacuguccucugggcaccucaagugcaggcugaagauggacaaacuucggcugaagggagugagcuauucauuguguacugcugccuucacguuuacaaaaauuccugcagagacccuccauggcacugucaccguggaaguucaguacgcggguacagacgggccaugcaaggugcccgcucaaauggccguagauaugcagacccugacuccugucggccgcuuaauaacagcaaacccagugaucacggagaguaccgaaaacuccaaaaugaugcuggagcuagaucccccguucggagacagcuacauuguuaucggcgugggggagaagaagauaacucaccacuggcauagaucuggaucaacaauugguaaagccuuugaagcuaccgucaggggcgccaagcguauggcagugcucggggacacagcuugggauuucggaaguguaggcggugcccugaauagccuugggaaaggcauccaccagaucuucggagcggccuuuaaguccuuguucggcgggaugucuugguuuucgcaaauucugaucggaacucuccugauguggcuuggccugaacaccaaaaaugguagcauuuccuugaugugucucgcuuuagggggagugcugauauuccugucaacggcaguuagugccgacgucggcugcugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8314 - RNA, 2317 nt, Artificial Sequence
  ZIKV prME variant mRNA Design 3 opt
gggagaaagcuuaccaugagaaggggcgccgacaccagcguggggaucgucggacugcuccuuacaacugcuauggcagccgagguuacgcggcgcgguuccgcguacuauauguaccuggaucgaaacgacgcuggcgaagccauuucuuuccccaccacauuggggaugaauaagugcuauauacagaucauggauuuaggacacaugugugacgcaacuaugucauacgagugcccuaugcuggaugaaggcguggagccagacgauguagacuguuggugcaacaccacaaguaccuggguggucuaugguacuugucaucacaaaaagggggaagcccguagaagcaggcgggcugugacacuaccgucccauucuacccgcaaacuccaaacgagaucgcagacuuggcuggagucaagggaguacaccaagcaccuuauucggguugaaaauuggaucuuucgcaaccccggauucgcacuggccgcugccgcgauugcaugguugcucggcagcaguacaucccagaaagugaucuaucuggucaugauacugcucaucgccccugcuuacucuauucgaugcaucggcgugagcaauagagauuuuguagaggggauguccggagguacuuggguugacauuguguuagaacauggcgggugugucaccgugauggcccaggauaagccaacaguggacaucgagcuggucaccacgacuguuucaaacauggcagaggugaggaguuacugcuaugaagcuagcauaucugauauggccuccgacucacggugucccacacaaggagaggcguaccuugacaagcagagcgauacccaguauguaugcaaacguacuuugguggaccgcggcugggguaauggguguggacuguucggcaagggcagucuagucacaugcgccaaauuugcaugcucuaagaaaaugaccgggaaguccauucagccugaaaaccucgaguacagaaucaugcugagcgugcacggaucgcaacacucugguaugauuguuaaugauacgggccaugaaaccgacgagaacagggcuaagguggagaucacaccaaauucaccccgggccgaagcuacucuugggggauucggcucccuggguuuggauugugagccucgaaccgggcucgacuuuagugaucuguauuacuuaacaaugaacaauaaacacuggcugguccauaaggaaugguuccacgacaucccacucccguggcacgccggcgcagauacuggaacaccccauuggaacaauaaagaggcccuuguggaauuuaaggacgcucacgcgaaacgccagaccguaguugugcugggcagccaggagggggcaguccauaccgccuuggcuggagcccuagaggcagaaauggauggugccaagggcagacuguccucugggcaccucaaaugcaggcugaagauggacaagcugcggcugaaaggagugagcuauucauuguguacugcugccuucacguuuacaaagauuccugcagagacccuccauggcacugucaccguggaaguucaguacgcggguacagacgggccaugcaaagugcccgcucaaauggccguagauaugcagacccugacuccugucggccgcuuaauaacagcaaacccagugaucacggagaguaccgaaaacuccaagaugaugcuggagcuagaucccccguucggagacagcuacauuguuaucggcgugggggagaaaaagauaacucaccacuggcauagaucuggaucaacaauugguaaggccuuugaagcuaccgucaggggcgccaaacguauggcagugcucggggacacagcuugggauuucggaaguguaggcggugcccugaauagccuugggaagggcauccaccagaucuucggagcggccuuuaaauccuuguucggcgggaugucuugguuuucgcaaauucugaucggaacucuccugauguggcuuggccugaacaccaagaaugguagcauuuccuugaugugucucgcucuugggggaguguuaauauuccugucaacggcaguuagugccgacgucggcugcugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8315 - RNA, 2314 nt, Artificial Sequence
  ZIKV prME variant mRNA Design 3 opt
gggagaaagcuuaccaugagaggcgccgacaccagcguggggaucgucggacugcuccuuacaacugcuauggcagccgagguuacgaggcgggguuccgcguacuauauguaccuggaucgcaacgacgcuggcgaagccauuucuuuccccaccacauuggggaugaauaagugcuauauacagaucauggauuuaggacacaugugugacgcaacuaugucauacgagugcccuaugcuggaugaaggcguggagccagacgauguagacuguuggugcaacaccacaaguaccuggguggucuaugguacuugucaucacaaaaagggggaagcccgacguagcagaagggcugugacacuaccgucccauucuacccggaaacuccaaacgcgcucgcagacuuggcuggagucaagagaguacaccaagcaccuuauuaggguugaaaauuggaucuuucggaaccccggauucgcacuggccgcugccgcgauugcaugguugcucggcagcaguacaucccagaaagugaucuaucuggucaugauacugcucaucgccccugcuuacucuauucgcugcaucggcgugagcaaucgagauuuuguagaggggauguccggagguacuuggguugacauuguguuagaacauggcgggugugucaccgugauggcccaggauaagccaacaguggacaucgagcuggucaccacgacuguuucaaacauggcagaggugagaaguuacugcuaugaagcuagcauaucugauauggccuccgacucaaggugucccacacaaggagaggcguaccuugacaagcagagcgauacccaguauguaugcaaacggacuuugguggaccguggcugggguaauggguguggacuguucggcaagggcagucuagucacaugcgccaaauuugcaugcucuaagaaaaugaccgggaaguccauucagccugaaaaccucgaguaccgcaucaugcugagcgugcacggaucgcaacacucugguaugauuguuaaugauacgggccaugaaaccgacgagaacagagcuaagguggagaucacaccaaauucccccagggccgaagcuacucuugggggauucggcucacuggguuuggauugugagccucggaccgggcucgacuuuagugaucuguauuacuuaacaaugaacaauaaacacuggcugguccauaaggaaugguuccacgacaucccacucccguggcacgccggcgcagauacuggaacaccccauuggaacaauaaagaggcccuuguggaauuuaaggacgcucacgcgaaacgacagaccguaguugugcugggcagccaggagggggcaguccauaccgccuuggcuggagcccuagaggcagaaauggauggugccaagggccgccuguccucugggcaccucaaaugcagacugaagauggacaagcugaggcugaaaggagugagcuauucauuguguacugcugccuucacguuuacaaagauuccugcagagacccuccauggcacugucaccguggaaguucaguacgcggguacagacgggccaugcaaagugcccgcucaaauggccguagauaugcagacccugacuccugucggccgguuaauaacagcaaacccagugaucacggagaguaccgaaaacuccaagaugaugcuggagcuagaucccccguucggagacagcuacauuguuaucggcgugggggagaaaaagauaacucaccacuggcaucgcucuggaucaacaauugguaaggccuuugaagcuaccgucagaggcgccaaaaggauggcagugcucggggacacagcuugggauuucggaaguguaggcggugcccugaauagccuugggaagggcauccaccagaucuucggagcggccuuuaaauccuuguucggcgggaugucuugguuuucgcaaauucugaucggaacucuccugauguggcuuggccugaacaccaagaaugguagcauuuccuugaugugucucgcucuugggggaguguuaauauuccugucaacggcaguuagugccgacgucggcugcugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8316 - RNA, 2311 nt, Artificial Sequence
  ZIKV prME variant mRNA Design 3 opt
gggagaaagcuuaccaugggcgccgacaccagcguggggaucgucggacugcuccuuacaacugcuauggcagccgagguuacgagaagggguuccgcguacuauauguaccuggaucggaacgacgcuggcgaagccauuucuuuccccaccacauuggggaugaauaagugcuauauacagaucauggauuuaggacacaugugugacgcaacuaugucauacgagugcccuaugcuggaugaaggcguggagccagacgauguagacuguuggugcaacaccacaaguaccuggguggucuaugguacuugucaucacaaaaagggggaagcccgccgaagccguagagcugugacacuaccgucccauucuaccaggaaacuccaaacgcggucgcagacuuggcuggagucacgcgaguacaccaagcaccuuauuagaguugaaaauuggaucuuuaggaaccccggauucgcacuggccgcugccgcgauugcaugguugcucggcagcaguacaucccagaaagugaucuaucuggucaugauacugcucaucgccccugcuuacucuauucggugcaucggcgugagcaaucgcgauuuuguagaggggauguccggagguacuuggguugacauuguguuagaacauggcgggugugucaccgugauggcccaggauaagccaacaguggacaucgagcuggucaccacgacuguuucaaacauggcagaggugcgaaguuacugcuaugaagcuagcauaucugauauggccuccgacucaagaugucccacacaaggagaggcguaccuugacaagcagagcgauacccaguauguaugcaaaaggacuuugguggaccggggcugggguaauggguguggacuguucggcaagggcagucuagucacaugcgccaaauuugcaugcucuaagaaaaugaccgggaaguccauucagccugaaaaccucgaguaccguaucaugcugagcgugcacggaucgcaacacucugguaugauuguuaaugauacgggccaugaaaccgacgagaaccgcgcuaagguggagaucacaccaaauucccccagagccgaagcuacucuugggggauucggcucacuggguuuggauugugagccuaggaccgggcucgacuuuagugaucuguauuacuuaacaaugaacaauaaacacuggcugguccauaaggaaugguuccacgacaucccacucccguggcacgccggcgcagauacuggaacaccccauuggaacaauaaagaggcccuuguggaauuuaaggacgcucacgcgaaacggcagaccguaguugugcugggcagccaggagggggcaguccauaccgccuuggcuggagcccuagaggcagaaauggauggugccaagggccgacuguccucugggcaccucaaaugccgccugaagauggacaagcugagacugaaaggagugagcuauucauuguguacugcugccuucacguuuacaaagauuccugcagagacccuccauggcacugucaccguggaaguucaguacgcggguacagacgggccaugcaaagugcccgcucaaauggccguagauaugcagacccugacuccugucggcagguuaauaacagcaaacccagugaucacggagaguaccgaaaacuccaagaugaugcuggagcuagaucccccguucggagacagcuacauuguuaucggcgugggggagaaaaagauaacucaccacuggcaucggucuggaucaacaauugguaaggccuuugaagcuaccguccgcggcgccaaaagaauggcagugcucggggacacagcuugggauuucggaaguguaggcggugcccugaauagccuugggaagggcauccaccagaucuucggagcggccuuuaaauccuuguucggcgggaugucuugguuuucgcaaauucugaucggaacucuccugauguggcuuggccugaacaccaagaaugguagcauuuccuugaugugucucgcucuugggggaguguuaauauuccugucaacggcaguuagugccgacgucggcugcugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8317 - RNA, 2308 nt, Artificial Sequence
  ZIKV prME variant mRNA Design 3 opt
gggagaaagcuuaccauggccgacaccagcgugggcaucgucgggcugcuccuuacaacugcuauggcagccgagguuacgagaaggggauccgcguacuauauguaccuggaucggaacgacgcuggugaagccauuucuuuccccaccacauugggcaugaauaagugcuauauacagaucauggauuuagggcacaugugugacgcaacuaugucauacgagugcccuaugcuggaugaaggaguggagccagacgauguagacuguuggugcaacaccacaaguaccuggguggucuauggcacuugucaucacaaaaagggugaagcccgccgaagccguagagcugugacacuaccgucccauucuaccaggaaacuccaaacgcggucgcagacuuggcuggagucacgcgaguacaccaagcaccuuauuagaguugaaaauuggaucuuuaggaaccccggguucgcacuggccgcugccgcgauugcaugguugcucggaagcaguacaucccagaaagugaucuaucuggucaugauacugcucaucgccccugcuuacucuauucggugcaucggcgugagcaaucgcgauuuuguagagggcauguccgggggaacuuggguugacauuguguuagaacaugguggcugugucaccgugauggcccaggauaagccaacaguggacaucgagcuggucaccacgacuguuucaaacauggcagaggugcgaaguuacugcuaugaagcuagcauaucugauauggccuccgacucaagaugucccacacaaggggaggcguaccuugacaagcagagcgauacccaguauguaugcaaaaggacuuugguggaccggggauggggcaaugguugugggcuguucggaaagggcagucuagucacaugcgccaaauuugcaugcucuaagaaaaugaccggcaaguccauucagccugaaaaccucgaguaccguaucaugcugagcgugcacgggucgcaacacucuggaaugauuguuaaugauacgggucaugaaaccgacgagaaccgcgcuaagguggagaucacaccaaauucccccagagccgaagcuacucuuggcggguucggaucacugggcuuggauugugagccuaggaccggucucgacuuuagugaucuguauuacuuaacaaugaacaauaaacacuggcugguccauaaggaaugguuccacgacaucccacucccguggcacgccggggcagauacuggcacaccccauuggaacaauaaagaggcccuuguggaauuuaaggacgcucacgcgaaacggcagaccguaguugugcugggaagccaggagggcgcaguccauaccgccuuggcuggggcccuagaggcagaaauggauggagccaagggucgacuguccucuggccaccucaaaugccgccugaagauggacaaacuuagacugaagggggugagcuauucauuguguacugcugccuucacguuuacaaagauuccugcagagacccuccauggaacugucaccguggaaguucaguacgcgggcacagacgguccaugcaaagugcccgcucaaauggccguagauaugcagacccugacuccugucgggagguuaauaacagcaaacccagugaucacggagaguaccgaaaacuccaagaugaugcuggagcuagaucccccguucggcgacagcuacauuguuaucggagugggcgagaaaaagauaacucaccacuggcaucggucugggucaacaauuggaaaggccuuugaagcuaccguccgcggugccaaaagaauggcagugcucggcgacacagcuugggauuucgggaguguaggaggcgcccugaauagccuugguaaggggauccaccagaucuucggcgcggccuuuaaauccuuguucggaggcaugucuugguuuucgcaaauucugaucgggacucuccugauguggcuuggacugaacaccaagaauggcagcauuuccuugaugugucucgcucugggugggguguuaauauuccugucaacggcaguuagugccgacgucggaugcugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8318 - RNA, 2305 nt, Artificial Sequence
  ZIKV prME variant mRNA Design 3 opt
gggagaaagcuuaccauggacaccagcgugggcaucgucgggcugcuccuuacaacugccauggcugcagagguuacgagaaggggauccgccuacuauauguaccuggaucggaacgacgcgggugaagcuauuucuuuccccaccacauugggcaugaauaagugcuauauacagaucauggauuuagggcacaugugugacgccacuaugucauacgagugcccuaugcuggaugaaggaguggagccagacgauguagacuguuggugcaacaccacaaguaccuggguggucuauggcacuugucaucacaaaaagggugaagcacgccgaagccguagagccgugacacuaccgucccauucuaccaggaaacuccaaacgcggucgcagacuuggcuggagucacgcgaguacaccaagcaccuuauuagaguugaaaauuggaucuuuaggaaccccggguucgcucuggcagccgcugccauugcgugguugcucggaagcaguacaucccagaaagugaucuaucuggucaugauacugcucaucgcacccgccuacucuauucggugcaucggcgugagcaaucgcgauuuuguagagggcauguccgggggaacuuggguugacauuguguuagaacaugguggcugugucaccgugauggcucaggauaagccaacaguggacaucgagcuggucaccacgacuguuucaaacauggccgaggugcgaaguuacugcuaugaagcaagcauaucugauauggcuuccgacucaagaugucccacacaaggggaggccuaccuugacaagcagagcgauacccaguauguaugcaaaaggacuuugguggaccggggauggggcaaugguugugggcuguucggaaagggcagucuagucacaugcgcgaaauuugccugcucuaagaaaaugaccggcaaguccauucagccugaaaaccucgaguaccguaucaugcugagcgugcacgggucgcaacacucuggaaugauuguuaaugauacgggucaugaaaccgacgagaaccgcgcaaagguggagaucacaccaaauucccccagagcugaagccacucuuggcggguucggaucacugggcuuggauugugagccuaggaccggucucgacuuuagugaucuguauuacuuaacaaugaacaauaaacacuggcugguccauaaggaaugguuccacgacaucccacucccguggcacgcuggggccgauacuggcaccccucauuggaacaauaaagaggcacuuguggaauuuaaggacgcccacgcuaaacggcagacaguaguugugcugggaagccaggagggcgcgguccauaccgcauuggccggggcucuagaggccgaaauggauggagcaaagggucgacuguccucuggccaccucaaaugccgccugaagauggacaaacuuagacugaagggggugagcuauucauuguguacugccgcuuucacguuuacaaagauuccugccgagacccuccauggaacugucaccguggaaguucaguacgcaggcacagacgguccaugcaaagugcccgcgcaaauggcuguagauaugcagacccugacuccugucgggagguuaauaacagccaacccagugaucacggagaguaccgaaaacuccaagaugaugcuggagcuagaucccccguucggcgacagcuacauuguuaucggagugggcgagaaaaagauaacucaccacuggcaucggucugggucaacaauuggaaaggcauuugaagccaccguccgcggugcuaaaagaauggccgugcucggcgacacagcaugggauuucgggaguguaggaggcgcucugaauagccuugguaaggggauccaccagaucuucggcgccgcguuuaaauccuuguucggaggcaugucuugguuuucgcaaauucugaucgggacucuccugauguggcuuggacugaacaccaagaauggcagcauuuccuugaugugucucgcccugggugggguguuaauauuccugucaacggcuguuagugcagacgucggaugcugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8319 - RNA, 2302 nt, Artificial Sequence
  ZIKV prME variant mRNA Design 3 opt
gggagaaagcuuaccaugaccagcgugggcaucgucgggcugcuccuuacaacugccauggcugcagagguuacgagaaggggauccgccuacuauauguaccuggaccggaacgaugcgggugaagcuauuucuuuccccaccacauugggcaugaauaagugcuauauacagaucauggacuuagggcacaugugugaugccacuaugucauacgagugcccuaugcuggacgaaggaguggagccagaugacguagauuguuggugcaacaccacaaguaccuggguggucuauggcacuugucaucacaaaaagggugaagcacgccgaagccguagagccgugacacuaccgucccauucuaccaggaaacuccaaacgcggucgcagacuuggcuggagucacgcgaguacaccaagcaccuuauuagaguugaaaauuggaucuuuaggaaccccggguucgcucuggcagccgcugccauugcgugguugcucggaagcaguacaucccagaaagugaucuaucuggucaugauacugcucaucgcacccgccuacucuauucggugcaucggcgugagcaaucgcgacuuuguagagggcauguccgggggaacuuggguugauauuguguuagaacaugguggcugugucaccgugauggcucaggacaagccaacaguggauaucgagcuggucaccacgacuguuucaaacauggccgaggugcgaaguuacugcuaugaagcaagcauaucugacauggcuuccgauucaagaugucccacacaaggggaggccuaccuugacaagcagagcgacacccaguauguaugcaaaaggacuuugguggaucggggauggggcaaugguugugggcuguucggaaagggcagucuagucacaugcgcgaaauuugccugcucuaagaaaaugaccggcaaguccauucagccugaaaaccucgaguaccguaucaugcugagcgugcacgggucgcaacacucuggaaugauuguuaaugacacgggucaugaaaccgaugagaaccgcgcaaagguggagaucacaccaaauucccccagagcugaagccacucuuggcggguucggaucacugggcuuggacugugagccuaggaccggucucgauuuuagugaccuguauuacuuaacaaugaacaauaaacacuggcugguccauaaggaaugguuccacgauaucccacucccguggcacgcuggggccgacacuggcaccccucauuggaacaauaaagaggcacuuguggaauuuaaggaugcccacgcuaaacggcagacaguaguugugcugggaagccaggagggcgcgguccauaccgcauuggccggggcucuagaggccgaaauggacggagcaaagggucgacuguccucuggccaccucaaaugccgccugaagauggauaaacuuagacugaagggggugagcuauucauuguguacugccgcuuucacguuuacaaagauuccugccgagacccuccauggaacugucaccguggaaguucaguacgcaggcacagacgguccaugcaaagugcccgcgcaaauggcuguagacaugcagacccugacuccugucgggagguuaauaacagccaacccagugaucacggagaguaccgaaaacuccaagaugaugcuggagcuagaucccccguucggcgacagcuacauuguuaucggagugggcgagaaaaagauaacucaccacuggcaucggucugggucaacaauuggaaaggcauuugaagccaccguccgcggugcuaaaagaauggccgugcucggcgauacagcaugggacuucgggaguguaggaggcgcucugaauagccuugguaaggggauccaccagaucuucggcgccgcguuuaaauccuuguucggaggcaugucuugguuuucgcaaauucugaucgggacucuccugauguggcuuggacugaacaccaagaauggcagcauuuccuugaugugucucgcccugggugggguguuaauauuccugucaacggcuguuagugcagaugucggaugcugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8320 - RNA, 2302 nt, Artificial Sequence
  ZIKV prME variant mRNA Design 3 opt
gggagaaagcuuaccaugaccagcgugggcaucgucgggcugcuccuuacaacugccauggcugcagccguuacgagaaggggauccgcguacuauauguaccuggaccggaacgaugcuggugaggccauuucuuuccccaccacauugggcaugaauaagugcuauauacagaucauggacuuagggcacaugugugaugcaacuaugucauacgaaugcccuaugcuggacgagggaguggaaccagaugacguagauuguuggugcaacaccacaaguaccuggguggucuauggcacuugucaucacaaaaagggugaggcccgccgaagccguagagcugugacacuaccgucccauucuaccaggaaacuccaaacgcggucgcagacuuggcuggaaucacgcgaguacaccaagcaccuuauuagaguugagaauuggaucuuuaggaaccccggguucgcacuggccgcugccgcgauugcaugguugcucggaagcaguacaucccagaaagugaucuaucuggucaugauacugcucaucgccccugcuuacucuauucggugcaucggcgugagcaaucgcgacuuuguagaaggcauguccgggggaacuuggguugauauuguguuagagcaugguggcugugucaccgugauggcccaggacaagccaacaguggauaucgaacuggucaccacgacuguuucaaacauggcagaggugcgaaguuacugcuaugaggcuagcauaucugacauggccuccgauucaagaugucccacacaaggggaagcguaccuugacaagcagagcgacacccaguauguaugcaaaaggacuuugguggaucggggauggggcaaugguugugggcuguucggaaagggcagucuagucacaugcgccaaauuugcaugcucuaagaaaaugaccggcaaguccauucagccugagaaccucgaauaccguaucaugcugagcgugcacgggucgcaacacucuggaaugauuguuaaugacacgggucaugagaccgaugaaaaccgcgcuaagguggagaucacaccaaauucccccagagccgaggcuacucuuggcggguucggaucacugggcuuggacugugaaccuaggaccggucucgauuuuagugaccuguauuacuuaacaaugaacaauaaacacuggcugguccauaaggagugguuccacgauaucccacucccguggcacgccggggcagacacuggcacaccccauuggaacaauaaagaagcccuuguggaguuuaaggaugcucacgcgaaacggcagaccguaguugugcugggaagccaggaaggcgcaguccauaccgccuuggcuggggcccuagaggcagagauggacggagccaagggucgacuguccucuggccaccucaaaugccgccugaagauggauaaacuuagacugaagggggugagcuauucauuguguacugcugccuucacguuuacaaagauuccugcagaaacccuccauggaacugucaccguggagguucaguacgcgggcacagacgguccaugcaaagugcccgcucaaauggccguagacaugcagacccugacuccugucgggagguuaauaacagcaaacccagugaucacggaaaguaccgagaacuccaagaugaugcuggaacuagaucccccguucggcgacagcuacauuguuaucggagugggcgagaaaaagauaacucaccacuggcaucggucugggucaacaauuggaaaggccuuugaggcuaccguccgcggugccaaaagaauggcagugcucggcgauacagcuugggacuucgggaguguaggaggcgcccugaauagccuugguaaggggauccaccagaucuucggcgcggccuuuaaauccuuguucggaggcaugucuugguuuucgcaaauucugaucgggacucuccugauguggcuuggacugaacaccaagaauggcagcauuuccuugaugugucucgcucugggugggguguuaauauuccugucaacggcaguuagugccgaugucggaugcugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8321 - RNA, 2314 nt, Artificial Sequence
  ZIKV prME variant mRNA Design 3 opt
gggagaaagcuuaccaugagaggcgccgacaccagcguggggaucgucggacugcuccuuacaacugcuauggcagccgcgguuacgaggcgggguuccgcuuacuauauguaccuggaucgcaacgacgccggcgaggcaauuucuuuccccaccacauuggggaugaauaagugcuauauacagaucauggauuuaggacacaugugugacgccacuaugucauacgaaugcccuaugcuggaugagggcguggaaccagacgauguagacuguuggugcaacaccacaaguaccuggguggucuaugguacuugucaucacaaaaagggggaggcucgacguagcagaagggcagugacacuaccgucccauucuacccggaaacuccaaacgcgcucgcagacuuggcuggaaucaagagaguacaccaagcaccuuauuaggguugagaauuggaucuuucggaaccccggauucgcccuggcugccgcggcaauugccugguugcucggcagcaguacaucccagaaagugaucuaucuggucaugauacugcucaucgcuccugccuacucuauucgcugcaucggcgugagcaaucgagauuuuguagaagggauguccggagguacuuggguugacauuguguuagagcauggcgggugugucaccgugauggcacaggauaagccaacaguggacaucgaacuggucaccacgacuguuucaaacauggcugaggugagaaguuacugcuaugaggccagcauaucugauauggcguccgacucaaggugucccacacaaggagaagccuaccuugacaagcagagcgauacccaguauguaugcaaacggacuuugguggaccguggcugggguaauggguguggacuguucggcaagggcagucuagucacaugcgcaaaauuugcuugcucuaagaaaaugaccgggaaguccauucagccugagaaccucgaauaccgcaucaugcugagcgugcacggaucgcaacacucugguaugauuguuaaugauacgggccaugagaccgacgaaaacagagccaagguggagaucacaccaaauucccccagggcugaggccacucuugggggauucggcucacuggguuuggauugugaaccucggaccgggcucgacuuuagugaucuguauuacuuaacaaugaacaauaaacacuggcugguccauaaggagugguuccacgacaucccacucccguggcacgcaggcgccgauacuggaacaccccauuggaacaauaaagaagcucuuguggaguuuaaggacgcgcacgcaaaacgacagaccguaguugugcugggcagccaggaaggggccguccauaccgcuuuggccggagcacuagaggccgagauggauggugcuaagggccgccuguccucugggcaccucaaaugcagacugaagauggacaagcugaggcugaaaggagugagcuauucauuguguacugccgcauucacguuuacaaagauuccugcggaaacccuccauggcacugucaccguggagguucaguacgcugguacagacgggccaugcaaagugcccgcccaaauggcaguagauaugcagacccugacuccugucggccgguuaauaacagccaacccagugaucacggaaaguaccgagaacuccaagaugaugcuggaacuagaucccccguucggagacagcuacauuguuaucggcgugggggagaaaaagauaacucaccacuggcaucgcucuggaucaacaauugguaaggcuuuugaggccaccgucagaggcgcaaaaaggauggcugugcucggggacacagccugggauuucggaaguguaggcggugcgcugaauagccuugggaagggcauccaccagaucuucggagccgcuuuuaaauccuuguucggcgggaugucuugguuuucgcaaauucugaucggaacucuccugauguggcuuggccugaacaccaagaaugguagcauuuccuugaugugucucgcacuugggggaguguuaauauuccugucaacggccguuagugcugacgucggcugcugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8322 - RNA, 2338 nt, Artificial Sequence
  ZIKV prME variant mRNA Design 3 opt
gggagaaagcuuaccaugagaggccugagcuccaggaagcggcgcucucacgacgugcucaccguccaguuccuuauccuggggauguuguuaaugacaggagguguuacucgacguggcucagccuacuauauguaccuggauagaaacgacgcuggggaggcaauuaguuuucccacgacccuaggaaugaauaaaugcuauauacaaaucauggaucucggccauaugugugacgccacaaugagcuacgaaugcccuaugcuggaugaggguguggaaccagacgauguagacuguuggugcaacacuaccuccacauggguggucuaugggaccugucaccauaagaaaggagaggcgaggcggucucgcagagcugugacucuuccgucgcacucaacaaggaagcugcagacccggagccagacgugguuggaaagucgcgaguacacuaaacaucucauucgaguugagaauuggaucuucagaaaccccggcuuugcccuggcagccgcugcaauugccuggcugcucggcuccucuaccagccagaaggugaucuauuuagucaugauacugcuuaucgcuccugccuacuccauuaggugcaucggggugucaaaucgggauuucguagaaggaaugagugguggcacauggguugacauuguguuggagcacgggggaugugucacugugauggcgcaagauaagccaaccguggacaucgaacuggucacaaccacgguuagcaacauggcagaggugcguucuuacugcuaugaggccuccauaucagauauggcuagcgacagucgcugucccacucagggcgaagccuaccuagacaaacagucugauacacaguauguaugcaagagaacccucguggacagggguugggggaauggauguggccuguuuggcaaagggucccuugucacuugcgcaaaguucgcuugcagcaaaaagaugacaggaaagucgauucaaccugagaaccuggaauaccggaucauguugucugugcacgguucccagcauucaggcaugauuguuaaugauaccgggcacgagacggacgaaaaccgagccaaaguggagaucaccccaaauaguccccgcgcggaggccacacucggaggcuuugguagccugggguuagauugugaaccuagaacuggccuggacuucuccgaucucuauuaccuuaccaugaacaauaagcauuggcugguccacaaagagugguuucacgacaucccauugccguggcaugcaggagcugauacaggcacuccccacuggaacaauaaggaagcccuaguggaguucaaagacgcucaugccaagaggcagaccguaguugugcuggggucucaggaaggagcaguccacacagcccucgcuggugcgcuggaggcagagauggauggcgccaaagggcggcuuagcucaggacaucugaagugccgcuugaagauggacaaacucagacugaagggcgugaguuauuccuuauguaccgcugccuuuacuuucacgaaaauuccugcagaaacacugcacgguaccgucacuguggagguucaauacgccgggaccgacggcccaugcaaggugcccgcucagauggccguagauaugcagacacuaaccccugucggaaggcucauaacugcaaacccagugaucacagaaagcacggagaacucuaaaaugaugcuggaacuugaucccccguuuggcgacucauacauuguuaucggggugggagagaagaagauaacccaccauuggcaccguagugguagcacuauuggcaaagcguucgaggcuacaguccgaggggccaagcggauggcaguguugggagacaccgccugggauuucggcuccguagguggggcucucaauucucugggcaaaggaauccaucaaaucuuuggcgccgcauucaagucgcuguuugggggaaugagcugguucucccagauucuuaucggcacacuguugauguggcucggucugaacacuaaaaaugggucaauuaguuuaaugugucuggcucuaggaggcgugcucauauuucugucuaccgccguuagcgcggacgucgguugcugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8323 - RNA, 2338 nt, Artificial Sequence
  ZIKV prME variant mRNA Design 3 opt
gggagaaagcuuaccaugagaggccugagcuccaggaagcggcgcucucacgacgugcucaccguccaguuccuuauccuggggauguuguuaaugacaggagccguuacucgacgugguucagcuuacuauauguaccuggauagaaacgacgcaggcgaggccauuaguuuucccacgacccuagggaugaauaaaugcuauauacaaaucauggaucucggacauaugugugacgcgacaaugagcuacgaaugcccuaugcuggaugagggcguggaaccagacgauguagacuguuggugcaacacuaccuccacauggguggucuaugguaccugucaccauaagaaaggggaggcuaggcggucucgcagagccgugacucuuccgucgcacucaacaaggaagcugcagacccggagccagacgugguuggaaagucgcgaguacacuaaacaucucauucgaguugagaauuggaucuucagaaaccccggauuugcacuggccgcugcagccauugcuuggcugcucggcuccucuaccagccagaaggugaucuauuuagucaugauacugcuuaucgccccugcguacuccauuaggugcaucggcgugucaaaucgggauuucguagaagggaugaguggagguacauggguugacauuguguuggagcacggcgggugugucacugugauggcacaagauaagccaaccguggacaucgaacuggucacaaccacgguuagcaacauggccgaggugcguucuuacugcuaugaggcuuccauaucagauauggccagcgacagucgcugucccacucagggagaagcauaccuagacaaacagucugauacacaguauguaugcaagagaacccucguggacaggggcugggguaauggguguggacuguuuggcaaaggcucccuugucacuugcgcuaaguucgccugcagcaaaaagaugacagggaagucgauucaaccugagaaccuggaauaccggaucauguugucugugcacggaucccagcauucagguaugauuguuaaugauaccggccacgagacggacgaaaaccgagcgaaaguggagaucaccccaaauaguccccgcgccgaggcaacacucgggggauuuggcagccuggguuuagauugugaaccuagaacugggcuggacuucuccgaucucuauuaccuuaccaugaacaauaagcauuggcugguccacaaagagugguuucacgacaucccauugccguggcaugcuggcgccgauacaggaacuccccacuggaacaauaaggaagcucuaguggaguucaaagacgcccaugcaaagaggcagaccguaguugugcugggcucucaggaaggggccguccacacagcucucgcgggagcacuggaggccgagauggauggugcuaaaggccggcuuagcucagggcaucugaagugccgcuugaagauggacaaacucagacugaagggagugaguuauuccuuauguaccgccgcauuuacuuucacgaaaauuccugccgaaacacugcacggcaccgucacuguggagguucaauacgcugguaccgacgggccaugcaaggugcccgcccagauggcaguagauaugcagacacuaaccccugucggcaggcucauaacugcgaacccagugaucacagaaagcacggagaacucuaaaaugaugcuggaacuugaucccccguuuggagacucauacauuguuaucggcgugggggagaagaagauaacccaccauuggcaccguaguggaagcacuauugguaaggcuuucgaggccacaguccggggcgcaaaacgaauggccguguugggggacaccgcuugggauuucggauccguaggcggugcccucaauucucuggggaaaggcauccaucaaaucuuuggagcagcuuucaagucgcuguuuggcgggaugagcugguucucccagauucuuaucggaacacuguugauguggcucggccugaacacuaaaaaugguucaauuaguuuaaugugucuggcccuagggggagugcucauauuucugucuaccgcgguuagcgccgacgucggcugcugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8324 - RNA, 2338 nt, Artificial Sequence
  ZIKV prME variant mRNA Design 3 opt
gggagaaagcuuaccaugagaaucauuaacgccaggaaggagaaaaagcggcgcggcgcugacaccagcguggggauagucggacugcuccuuacaacugcaauggccgcggaaguuacgcgacgugguuccgcuuacuauauguaccuggauagaaaugacgccggcgaggcaaucucuuuccccaccacauuggggaugaacaaaugcuauauucagaucauggauuuaggacacaugugugacgccacuaugucauacgaaugcccuaugcuggaugagggcguggaaccagacgauguagacuguuggugcaauaccacaaguaccuggguggucuaugguacuugucaucacaagaaaggggaggcuaggcggagccgcagagcagugacacuaccgucccauucuaccaggaagcuccaaacgcggucgcagacuuggcuggagucacgcgaauacaccaagcaccuuauucgaguugagaacuggaucuuuagaaaucccggauucgcccuggcugccgcggcaauagccugguugcucggcagcaguacaucccagaaagugaucuaucuggucaugauucugcucaucgcuccugccuacucuauuaggugcaucggcgugagcaaccgggauuuuguagaagggauguccggagguacuuggguugacauaguguuagagcauggcgggugugucaccgugauggcacaggauaagccaacaguggacauugagcuggucaccacgacuguuucaaauauggcugaagugcguaguuacugcuaugaggccagcaucucugauauggcguccgacucacgcugucccacacaaggagaagccuaccuugacaaacagagcgauacccaguauguaugcaagagaacuuugguggacaggggcugggguaacggguguggacuguucggcaaaggcagucuagucacaugcgcaaaguuugcuugcucuaagaaaaugaccgggaaguccauucagccugagaaucucgaauaccggaucaugcugagcgugcacggaucgcaacacucugguaugaucguuaacgauacgggccaugagaccgacgagaaucgagccaaaguggaaauuacaccaaacucaccccgcgcugaggccacucuugggggauucggcucccuggguuuggauugugaaccuagaaccgggcucgacuuuagugaucuguauuacuuaacaaugaauaacaagcacuggcugguccauaaagagugguuccacgacauaccacucccguggcacgcaggcgccgauacuggaacaccccauuggaauaacaaggaagcucuuguggaguuuaaagacgcgcacgcaaagaggcagaccguaguugugcugggcagccaggagggggccguccauaccgcuuuggccggagcacuagaagccgagauggauggugcuaagggccggcuguccucugggcaccucaaaugccgccugaagauggacaaacuuagacugaagggagugagcuauucauuguguacugccgcauucacguuuacaaaaaucccugcggaaacccuccauggcacugucaccguggagguucaguacgcugguacagacgggccaugcaaggugcccgcccaaauggcaguagauaugcagacccugacuccugucggcagguuaauuacagccaacccagugaucacggaaaguaccgaaaauuccaagaugaugcuggagcuagaucccccguucggagacagcuacauaguuauuggcgugggggagaaaaagaucacucaccacuggcaucguucuggaucaacaaucgguaaggcuuuugaggccaccguccggggcgcaaaacgaauggcugugcucggggacacagccugggauuucggaaguguaggcggugcgcugaacagccuugggaaaggcauucaccagaucuucggagccgcuuuuaaguccuuguucggcgggaugucuugguuuucgcaaauucugauaggaacucuccugauguggcuuggccugaauaccaagaacgguagcaucuccuugaugugucucgcauuagggggagugcugauuuuccugucaacggccguuagugcugacugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8325 - RNA, 2335 nt, Artificial Sequence
  ZIKV prME variant mRNA Design 3 opt
gggagaaagcuuaccaugaucauuaacgccagaaaggagaaaaagaggcggggcgcugacaccagcguggggauagucggacugcuccuuacaacugcaauggccgcggaaguuacgcgccgagguuccgcuuacuauauguaccuggaucguaaugacgccggcgaggcaaucucuuuccccaccacauuggggaugaacaaaugcuauauucagaucauggauuuaggacacaugugugacgccacuaugucauacgaaugcccuaugcuggaugagggcguggaaccagacgauguagacuguuggugcaauaccacaaguaccuggguggucuaugguacuugucaucacaagaaaggggaggcuagaaggagccggcgcgcagugacacuaccgucccauucuaccagaaagcuccaaacgaggucgcagacuuggcuggagucacgggaauacaccaagcaccuuauucgcguugagaacuggaucuuucgaaaucccggauucgcccuggcugccgcggcaauagccugguugcucggcagcaguacaucccagaaagugaucuaucuggucaugauucugcucaucgcuccugccuacucuauuagaugcaucggcgugagcaacagggauuuuguagaagggauguccggagguacuuggguugacauaguguuagagcauggcgggugugucaccgugauggcacaggauaagccaacaguggacauugagcuggucaccacgacuguuucaaauauggcugaagugcggaguuacugcuaugaggccagcaucucugauauggcguccgacucacguugucccacacaaggagaagccuaccuugacaaacagagcgauacccaguauguaugcaagcgcacuuugguggacagaggcugggguaacggguguggacuguucggcaaaggcagucuagucacaugcgcaaaguuugcuugcucuaagaaaaugaccgggaaguccauucagccugagaaucucgaauacaggaucaugcugagcgugcacggaucgcaacacucugguaugaucguuaacgauacgggccaugagaccgacgagaaucgggccaaaguggaaauuacaccaaacucaccccgagcugaggccacucuugggggauucggcucccuggguuuggauugugaaccucgcaccgggcucgacuuuagugaucuguauuacuuaacaaugaauaacaagcacuggcugguccauaaagagugguuccacgacauaccacucccguggcacgcaggcgccgauacuggaacaccccauuggaauaacaaggaagcucuuguggaguuuaaagacgcgcacgcaaagagacagaccguaguugugcugggcagccaggagggggccguccauaccgcuuuggccggagcacuagaagccgagauggauggugcuaagggcaggcuguccucugggcaccucaaaugccggcugaagauggacaaacuucgccugaagggagugagcuauucauuguguacugccgcauucacguuuacaaaaaucccugcggaaacccuccauggcacugucaccguggagguucaguacgcugguacagacgggccaugcaaggugcccgcccaaauggcaguagauaugcagacccugacuccugucggcagauuaauuacagccaacccagugaucacggaaaguaccgaaaauuccaagaugaugcuggagcuagaucccccguucggagacagcuacauaguuauuggcgugggggagaaaaagaucacucaccacuggcauaggucuggaucaacaaucgguaaggcuuuugaggccaccguccguggcgcaaaacggauggcugugcucggggacacagccugggauuucggaaguguaggcggugcgcugaacagccuugggaaaggcauucaccagaucuucggagccgcuuuuaaguccuuguucggcgggaugucuugguuuucgcaaauucugauaggaacucuccugauguggcuuggccugaauaccaagaacgguagcaucuccuugaugugucucgcauuagggggagugcugauuuuccugucaacggccguuagugcugacugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8326 - RNA, 2332 nt, Artificial Sequence
  ZIKV prME variant mRNA Design 3 opt
gggagaaagcuuaccaugaucaacgccagaaaggagaaaaagaggcggggcgcugacaccagcguggggauugucggacugcuccuuacaacugcaauggccgcggaaguuacgcgccgagguuccgcuuacuauauguaccuggaucguaaugacgccggcgaggcaauaucuuuccccaccacauuggggaugaacaaaugcuauauccagauuauggauuuaggacacaugugugacgccacuaugucauacgaaugcccuaugcuggaugagggcguggaaccagacgauguagacuguuggugcaauaccacaaguaccuggguggucuaugguacuugucaucacaagaaaggggaggcuagaaggagccggcgcgcagugacacuaccgucccauucuaccagaaagcuccaaacgaggucgcagacuuggcuggagucacgggaauacaccaagcaccuuauccgcguugagaacuggauuuuucgaaaucccggauucgcccuggcugccgcggcaaucgccugguugcucggcagcaguacaucccagaaagugauauaucuggucaugauccugcucauugcuccugccuacucuaucagaugcauuggcgugagcaacagggauuuuguagaagggauguccggagguacuuggguugacaucguguuagagcauggcgggugugucaccgugauggcacaggauaagccaacaguggacauagagcuggucaccacgacuguuucaaauauggcugaagugcggaguuacugcuaugaggccagcauuucugauauggcguccgacucacguugucccacacaaggagaagccuaccuugacaaacagagcgauacccaguauguaugcaagcgcacuuugguggacagaggcugggguaacggguguggacuguucggcaaaggcagucuagucacaugcgcaaaguuugcuugcucuaagaaaaugaccgggaaguccauccagccugagaaucucgaauacaggauuaugcugagcgugcacggaucgcaacacucugguaugaucguuaacgauacgggccaugagaccgacgagaaucgggccaaaguggaaaucacaccaaacucaccccgagcugaggccacucuugggggauucggcucccuggguuuggauugugaaccucgcaccgggcucgacuuuagugaucuguauuacuuaacaaugaauaacaagcacuggcugguccauaaagagugguuccacgacauuccacucccguggcacgcaggcgccgauacuggaacaccccauuggaauaacaaggaagcucuuguggaguuuaaagacgcgcacgcaaagagacagaccguaguugugcugggcagccaggagggggccguccauaccgcuuuggccggagcacuagaagccgagauggauggugcuaagggcaggcuguccucugggcaccucaaaugccggcugaagauggacaaacuucgccugaagggagugagcuauucauuguguacugccgcauucacguuuacaaaaauaccugcggaaacccuccauggcacugucaccguggagguucaguacgcugguacagacgggccaugcaaggugcccgcccaaauggcaguagauaugcagacccugacuccugucggcagauuaaucacagccaacccagugauuacggaaaguaccgaaaauuccaagaugaugcuggagcuagaucccccguucggagacagcuacaucguuauaggcgugggggagaaaaagauuacucaccacuggcauaggucuggaucaacaaucgguaaggcuuuugaggccaccguccguggcgcaaaacggauggcugugcucggggacacagccugggauuucggaaguguaggcggugcgcugaacagccuugggaaaggcauccaccagauuuucggagccgcuuuuaaguccuuguucggcgggaugucuugguuuucgcaaauccugauuggaacucuccugauguggcuuggccugaauaccaagaacgguagcauauccuugaugugucucgcauuagggggagugcugaucuuccugucaacggccguuagugcugacugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8327 - RNA, 2329 nt, Artificial Sequence
  ZIKV prME variant mRNA Design 3 opt
gggagaaagcuuaccaugaacgccagaaaggagaaaaagaggcggggcgcugacaccagcguggggaucgucggacugcuccuuacaacugcaauggccgcggaaguuacgcgccgagguuccgcuuacuauauguaccuggaucguaaugacgccggcgaggcaauuucuuuccccaccacauuggggaugaacaaaugcuauauacagaucauggauuuaggacacaugugugacgccacuaugucauacgaaugcccuaugcuggaugagggcguggaaccagacgauguagacuguuggugcaauaccacaaguaccuggguggucuaugguacuugucaucacaagaaaggggaggcuagaaggagccggcgcgcagugacacuaccgucccauucuaccagaaagcuccaaacgaggucgcagacuuggcuggagucacgggaauacaccaagcaccuuauucgcguugagaacuggaucuuucgaaaucccggauucgcccuggcugccgcggcaauugccugguugcucggcagcaguacaucccagaaagugaucuaucuggucaugauacugcucaucgcuccugccuacucuauuagaugcaucggcgugagcaacagggauuuuguagaagggauguccggagguacuuggguugacauuguguuagagcauggcgggugugucaccgugauggcacaggauaagccaacaguggacaucgagcuggucaccacgacuguuucaaauauggcugaagugcggaguuacugcuaugaggccagcauaucugauauggcguccgacucacguugucccacacaaggagaagccuaccuugacaaacagagcgauacccaguauguaugcaagcgcacuuugguggacagaggcugggguaacggguguggacuguucggcaaaggcagucuagucacaugcgcaaaguuugcuugcucuaagaaaaugaccgggaaguccauucagccugagaaucucgaauacaggaucaugcugagcgugcacggaucgcaacacucugguaugauuguuaacgauacgggccaugagaccgacgagaaucgggccaaaguggaaaucacaccaaacucaccccgagcugaggccacucuugggggauucggcucccuggguuuggauugugaaccucgcaccgggcucgacuuuagugaucuguauuacuuaacaaugaauaacaagcacuggcugguccauaaagagugguuccacgacaucccacucccguggcacgcaggcgccgauacuggaacaccccauuggaauaacaaggaagcucuuguggaguuuaaagacgcgcacgcaaagagacagaccguaguugugcugggcagccaggagggggccguccauaccgcuuuggccggagcacuagaagccgagauggauggugcuaagggcaggcuguccucugggcaccucaaaugccggcugaagauggacaaacuucgccugaagggagugagcuauucauuguguacugccgcauucacguuuacaaaaauuccugcggaaacccuccauggcacugucaccguggagguucaguacgcugguacagacgggccaugcaaggugcccgcccaaauggcaguagauaugcagacccugacuccugucggcagauuaauaacagccaacccagugaucacggaaaguaccgaaaauuccaagaugaugcuggagcuagaucccccguucggagacagcuacauuguuaucggcgugggggagaaaaagauaacucaccacuggcauaggucuggaucaacaauugguaaggcuuuugaggccaccguccguggcgcaaaacggauggcugugcucggggacacagccugggauuucggaaguguaggcggugcgcugaacagccuugggaaaggcauccaccagaucuucggagccgcuuuuaaguccuuguucggcgggaugucuugguuuucgcaaauucugaucggaacucuccugauguggcuuggccugaauaccaagaacgguagcauuuccuugaugugucucgcauuagggggagugcugauauuccugucaacggccguuagugcugacugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8328 - RNA, 2326 nt, Artificial Sequence
  ZIKV prME variant mRNA Design 3 opt
gggagaaagcuuaccauggccagaaaggagaaaaagaggcggggcgcugacaccagcguggggaucgucggacugcuccuuacaacugcaauggccgcggaaguuacgcgccgagguuccgcuuacuauauguaccuggaucguaacgacgccggcgaggcaauuucuuuccccaccacauuggggaugaauaaaugcuauauacagaucauggauuuaggacacaugugugacgccacuaugucauacgaaugcccuaugcuggaugagggcguggaaccagacgauguagacuguuggugcaacaccacaaguaccuggguggucuaugguacuugucaucacaagaaaggggaggcuagaaggagccggcgcgcagugacacuaccgucccauucuaccagaaagcuccaaacgaggucgcagacuuggcuggagucacgggaauacaccaagcaccuuauucgcguugagaauuggaucuuucgaaaccccggauucgcccuggcugccgcggcaauugccugguugcucggcagcaguacaucccagaaagugaucuaucuggucaugauacugcucaucgcuccugccuacucuauuagaugcaucggcgugagcaauagggauuuuguagaagggauguccggagguacuuggguugacauuguguuagagcauggcgggugugucaccgugauggcacaggauaagccaacaguggacaucgagcuggucaccacgacuguuucaaacauggcugaagugcggaguuacugcuaugaggccagcauaucugauauggcguccgacucacguugucccacacaaggagaagccuaccuugacaaacagagcgauacccaguauguaugcaagcgcacuuugguggacagaggcugggguaauggguguggacuguucggcaaaggcagucuagucacaugcgcaaaguuugcuugcucuaagaaaaugaccgggaaguccauucagccugagaaccucgaauacaggaucaugcugagcgugcacggaucgcaacacucugguaugauuguuaaugauacgggccaugagaccgacgagaaccgggccaaaguggaaaucacaccaaauucaccccgagcugaggccacucuugggggauucggcucccuggguuuggauugugaaccucgcaccgggcucgacuuuagugaucuguauuacuuaacaaugaacaauaagcacuggcugguccauaaagagugguuccacgacaucccacucccguggcacgcaggcgccgauacuggaacaccccauuggaacaauaaggaagcucuuguggaguuuaaagacgcgcacgcaaagagacagaccguaguugugcugggcagccaggagggggccguccauaccgcuuuggccggagcacuagaagccgagauggauggugcuaagggcaggcuguccucugggcaccucaaaugccggcugaagauggacaaacuucgccugaagggagugagcuauucauuguguacugccgcauucacguuuacaaaaauuccugcggaaacccuccauggcacugucaccguggagguucaguacgcugguacagacgggccaugcaaggugcccgcccaaauggcaguagauaugcagacccugacuccugucggcagauuaauaacagccaacccagugaucacggaaaguaccgagaacuccaagaugaugcuggagcuagaucccccguucggagacagcuacauuguuaucggcgugggggagaaaaagauaacucaccacuggcauaggucuggaucaacaauugguaaggcuuuugaagccaccguccguggcgcaaaacggauggcugugcucggggacacagccugggauuucggaaguguaggcggugcgcugaauagccuugggaaaggcauccaccagaucuucggagccgcuuuuaaguccuuguucggcgggaugucuugguuuucgcaaauucugaucggaacucuccugauguggcuuggccugaacaccaagaaugguagcauuuccuugaugugucucgcauuagggggagugcugauauuccugucaacggccguuagugcugacugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8329 - RNA, 2323 nt, Artificial Sequence
  ZIKV prME variant mRNA Design 3 opt
gggagaaagcuuaccaugagaaaggagaaaaagaggcggggcgccgacaccagcguggggaucgucggacugcuccuuacaacugcuauggcagccgaaguuacgcgccgagguuccgcguacuauauguaccuggaucguaacgacgcuggcgaggccauuucuuuccccaccacauuggggaugaauaaaugcuauauacagaucauggauuuaggacacaugugugacgcaacuaugucauacgaaugcccuaugcuggaugagggcguggaaccagacgauguagacuguuggugcaacaccacaaguaccuggguggucuaugguacuugucaucacaagaaaggggaggccagaaggagccggcgcgcugugacacuaccgucccauucuaccagaaagcuccaaacgaggucgcagacuuggcuggagucacgggaauacaccaagcaccuuauucgcguugagaauuggaucuuucgaaaccccggauucgcacuggccgcugccgcgauugcaugguugcucggcagcaguacaucccagaaagugaucuaucuggucaugauacugcucaucgccccugcuuacucuauuagaugcaucggcgugagcaauagggauuuuguagaagggauguccggagguacuuggguugacauuguguuagagcauggcgggugugucaccgugauggcccaggauaagccaacaguggacaucgagcuggucaccacgacuguuucaaacauggcagaagugcggaguuacugcuaugaggcuagcauaucugauauggccuccgacucacguugucccacacaaggagaagcguaccuugacaaacagagcgauacccaguauguaugcaagcgcacuuugguggacagaggcugggguaauggguguggacuguucggcaaaggcagucuagucacaugcgccaaguuugcaugcucuaagaaaaugaccgggaaguccauucagccugagaaccucgaauacaggaucaugcugagcgugcacggaucgcaacacucugguaugauuguuaaugauacgggccaugagaccgacgagaaccgggcuaaaguggaaaucacaccaaauucaccccgagccgaggcuacucuugggggauucggcucccuggguuuggauugugaaccucgcaccgggcucgacuuuagugaucuguauuacuuaacaaugaacaauaagcacuggcugguccauaaagagugguuccacgacaucccacucccguggcacgccggcgcagauacuggaacaccccauuggaacaauaaggaagcccuuguggaguuuaaagacgcucacgcgaagagacagaccguaguugugcugggcagccaggagggggcaguccauaccgccuuggcuggagcccuagaagcagagauggauggugccaagggcaggcuguccucugggcaccucaaaugccggcugaagauggacaaacuucgccugaagggagugagcuauucauuguguacugcugccuucacguuuacaaaaauuccugcagaaacccuccauggcacugucaccguggagguucaguacgcggguacagacgggccaugcaaggugcccgcucaaauggccguagauaugcagacccugacuccugucggcagauuaauaacagcaaacccagugaucacggaaaguaccgagaacuccaagaugaugcuggagcuagaucccccguucggagacagcuacauuguuaucggcgugggggagaaaaagauaacucaccacuggcauaggucuggaucaacaauugguaaagccuuugaagcuaccguccguggcgccaagcggauggcagugcucggggacacagcuugggauuucggaaguguaggcggugcccugaauagccuugggaaaggcauccaccagaucuucggagcggccuuuaaguccuuguucggcgggaugucuugguuuucgcaaauucugaucggaacucuccugauguggcuuggccugaacaccaagaaugguagcauuuccuugaugugucucgcuuuagggggagugcugauauuccugucaacggcaguuagugccgacugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8330 - RNA, 2320 nt, Artificial Sequence
  ZIKV prME variant mRNA Design 3 opt
gggagaaagcuuaccaugaaggagaaaaagagaaggggcgccgacaccagcguggggaucgucggacugcuccuuacaacugcuauggcagccgaaguuacgcggcgcgguuccgcguacuauauguaccuggaucgaaacgacgcuggcgaggccauuucuuuccccaccacauuggggaugaauaaaugcuauauacagaucauggauuuaggacacaugugugacgcaacuaugucauacgaaugcccuaugcuggaugagggcguggaaccagacgauguagacuguuggugcaacaccacaaguaccuggguggucuaugguacuugucaucacaagaaaggggaggcccguagaagcaggcgggcugugacacuaccgucccauucuacccgcaagcuccaaacgagaucgcagacuuggcuggagucaagggaauacaccaagcaccuuauucggguugagaauuggaucuuucgcaaccccggauucgcacuggccgcugccgcgauugcaugguugcucggcagcaguacaucccagaaagugaucuaucuggucaugauacugcucaucgccccugcuuacucuauucgaugcaucggcgugagcaauagagauuuuguagaagggauguccggagguacuuggguugacauuguguuagagcauggcgggugugucaccgugauggcccaggauaagccaacaguggacaucgagcuggucaccacgacuguuucaaacauggcagaagugaggaguuacugcuaugaggcuagcauaucugauauggccuccgacucacggugucccacacaaggagaagcguaccuugacaaacagagcgauacccaguauguaugcaagcguacuuugguggaccgcggcugggguaauggguguggacuguucggcaaaggcagucuagucacaugcgccaaguuugcaugcucuaagaaaaugaccgggaaguccauucagccugagaaccucgaauacagaaucaugcugagcgugcacggaucgcaacacucugguaugauuguuaaugauacgggccaugagaccgacgagaacagggcuaaaguggaaaucacaccaaauucaccccgggccgaggcuacucuugggggauucggcucccuggguuuggauugugaaccucgaaccgggcucgacuuuagugaucuguauuacuuaacaaugaacaauaagcacuggcugguccauaaagagugguuccacgacaucccacucccguggcacgccggcgcagauacuggaacaccccauuggaacaauaaggaagcccuuguggaguuuaaagacgcucacgcgaagcgccagaccguaguugugcugggcagccaggagggggcaguccauaccgccuuggcuggagcccuagaagcagagauggauggugccaagggcagacuguccucugggcaccucaaaugcaggcugaagauggacaaacuucggcugaagggagugagcuauucauuguguacugcugccuucacguuuacaaaaauuccugcagaaacccuccauggcacugucaccguggagguucaguacgcggguacagacgggccaugcaaggugcccgcucaaauggccguagauaugcagacccugacuccugucggccgcuuaauaacagcaaacccagugaucacggaaaguaccgagaacuccaagaugaugcuggagcuagaucccccguucggagacagcuacauuguuaucggcgugggggagaaaaagauaacucaccacuggcauagaucuggaucaacaauugguaaagccuuugaagcuaccgucaggggcgccaagcguauggcagugcucggggacacagcuugggauuucggaaguguaggcggugcccugaauagccuugggaaaggcauccaccagaucuucggagcggccuuuaaguccuuguucggcgggaugucuugguuuucgcaaauucugaucggaacucuccugauguggcuuggccugaacaccaagaaugguagcauuuccuugaugugucucgcuuuagggggagugcugauauuccugucaacggcaguuagugccgacugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8331 - RNA, 2317 nt, Artificial Sequence
  ZIKV prME variant mRNA Design 3 opt
gggagaaagcuuaccauggagaagaaaagaaggggcgccgacaccagcguggggaucgucggacugcuccuuacaacugcuauggcagccgaaguuacgcggcgcgguuccgcguacuauauguaccuggaucgaaacgacgcuggcgaggccauuucuuuccccaccacauuggggaugaauaagugcuauauacagaucauggauuuaggacacaugugugacgcaacuaugucauacgaaugcccuaugcuggaugagggcguggaaccagacgauguagacuguuggugcaacaccacaaguaccuggguggucuaugguacuugucaucacaaaaagggggaggcccguagaagcaggcgggcugugacacuaccgucccauucuacccgcaaacuccaaacgagaucgcagacuuggcuggagucaagggaauacaccaagcaccuuauucggguugagaauuggaucuuucgcaaccccggauucgcacuggccgcugccgcgauugcaugguugcucggcagcaguacaucccagaaggugaucuaucuggucaugauacugcucaucgccccugcuuacucuauucgaugcaucggcgugagcaauagagauuuuguagaagggauguccggagguacuuggguugacauuguguuagagcauggcgggugugucaccgugauggcccaggauaaaccaacaguggacaucgagcuggucaccacgacuguuucaaacauggcagaagugaggaguuacugcuaugaggcuagcauaucugauauggccuccgacucacggugucccacacaaggagaagcguaccuugacaagcagagcgauacccaguauguaugcaaacguacuuugguggaccgcggcugggguaauggguguggacuguucggcaagggcagucuagucacaugcgccaaauuugcaugcucuaagaagaugaccgggaaauccauucagccugagaaccucgaauacagaaucaugcugagcgugcacggaucgcaacacucugguaugauuguuaaugauacgggccaugagaccgacgagaacagggcuaagguggaaaucacaccaaauucaccccgggccgaggcuacucuugggggauucggcucccuggguuuggauugugaaccucgaaccgggcucgacuuuagugaucuguauuacuuaacaaugaacaauaaacacuggcugguccauaaggagugguuccacgacaucccacucccguggcacgccggcgcagauacuggaacaccccauuggaacaauaaagaagcccuuguggaguuuaaggacgcucacgcgaaacgccagaccguaguugugcugggcagccaggagggggcaguccauaccgccuuggcuggagcccuagaagcagagauggauggugccaagggcagacuguccucugggcaccucaagugcaggcugaaaauggacaagcugcggcugaaaggagugagcuauucauuguguacugcugccuucacguuuacaaagauuccugcagaaacccuccauggcacugucaccguggagguucaguacgcggguacagacgggccaugcaaagugcccgcucaaauggccguagauaugcagacccugacuccugucggccgcuuaauaacagcaaacccagugaucacggaaaguaccgagaacuccaagaugaugcuggagcuagaucccccguucggagacagcuacauuguuaucggcgugggggaaaagaaaauaacucaccacuggcauagaucuggaucaacaauugguaaggccuuugaggcuaccgucaggggcgccaaacguauggcagugcucggggacacagcuugggauuucggaaguguaggcggugcccugaauagccuugggaagggcauccaccagaucuucggagcggccuuuaaauccuuguucggcgggaugucuugguuuucgcaaauucugaucggaacucuccugauguggcuuggccugaacaccaagaaugguagcauuuccuugaugugucucgcucuugggggaguguuaauauuccugucaacggcaguuagugccgacugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8332 - RNA, 2314 nt, Artificial Sequence
  ZIKV prME variant mRNA Design 3 opt
gggagaaagcuuaccaugaagaaaagaaggggcgccgacaccagcguggggaucgucggacugcuccuuacaacugcuauggcagccgagguuacgcggcgcgguuccgcguacuauauguaccuggaucgaaacgacgcuggcgaagccauuucuuuccccaccacauuggggaugaauaagugcuauauacagaucauggauuuaggacacaugugugacgcaacuaugucauacgagugcccuaugcuggaugaaggcguggagccagacgauguagacuguuggugcaacaccacaaguaccuggguggucuaugguacuugucaucacaaaaagggggaagcccguagaagcaggcgggcugugacacuaccgucccauucuacccgcaaacuccaaacgagaucgcagacuuggcuggagucaagggaguacaccaagcaccuuauucggguugaaaauuggaucuuucgcaaccccggauucgcacuggccgcugccgcgauugcaugguugcucggcagcaguacaucccagaaggugaucuaucuggucaugauacugcucaucgccccugcuuacucuauucgaugcaucggcgugagcaauagagauuuuguagaggggauguccggagguacuuggguugacauuguguuagaacauggcgggugugucaccgugauggcccaggauaaaccaacaguggacaucgagcuggucaccacgacuguuucaaacauggcagaggugaggaguuacugcuaugaagcuagcauaucugauauggccuccgacucacggugucccacacaaggagaggcguaccuugacaagcagagcgauacccaguauguaugcaaacguacuuugguggaccgcggcugggguaauggguguggacuguucggcaagggcagucuagucacaugcgccaaauuugcaugcucuaagaagaugaccgggaaauccauucagccugaaaaccucgaguacagaaucaugcugagcgugcacggaucgcaacacucugguaugauuguuaaugauacgggccaugaaaccgacgagaacagggcuaagguggagaucacaccaaauucaccccgggccgaagcuacucuugggggauucggcucccuggguuuggauugugagccucgaaccgggcucgacuuuagugaucuguauuacuuaacaaugaacaauaaacacuggcugguccauaaggaaugguuccacgacaucccacucccguggcacgccggcgcagauacuggaacaccccauuggaacaauaaagaggcccuuguggaauuuaaggacgcucacgcgaaacgccagaccguaguugugcugggcagccaggagggggcaguccauaccgccuuggcuggagcccuagaggcagaaauggauggugccaagggcagacuguccucugggcaccucaagugcaggcugaaaauggacaagcugcggcugaaaggagugagcuauucauuguguacugcugccuucacguuuacaaagauuccugcagagacccuccauggcacugucaccguggaaguucaguacgcggguacagacgggccaugcaaagugcccgcucaaauggccguagauaugcagacccugacuccugucggccgcuuaauaacagcaaacccagugaucacggagaguaccgaaaacuccaagaugaugcuggagcuagaucccccguucggagacagcuacauuguuaucggcgugggggagaagaaaauaacucaccacuggcauagaucuggaucaacaauugguaaggccuuugaagcuaccgucaggggcgccaaacguauggcagugcucggggacacagcuugggauuucggaaguguaggcggugcccugaauagccuugggaagggcauccaccagaucuucggagcggccuuuaaauccuuguucggcgggaugucuugguuuucgcaaauucugaucggaacucuccugauguggcuuggccugaacaccaagaaugguagcauuuccuugaugugucucgcucuugggggaguguuaauauuccugucaacggcaguuagugccgacugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8333 - RNA, 2311 nt, Artificial Sequence
  ZIKV prME variant mRNA Design 3 opt
gggagaaagcuuaccaugaagagaaggggcgccgacaccagcguggggaucgucggacugcuccuuacaacugcuauggcagccgagguuacgcggcgcgguuccgcguacuauauguaccuggaucgaaacgacgcuggcgaagccauuucuuuccccaccacauuggggaugaauaaaugcuauauacagaucauggauuuaggacacaugugugacgcaacuaugucauacgagugcccuaugcuggaugaaggcguggagccagacgauguagacuguuggugcaacaccacaaguaccuggguggucuaugguacuugucaucacaagaaaggggaagcccguagaagcaggcgggcugugacacuaccgucccauucuacccgcaagcuccaaacgagaucgcagacuuggcuggagucaagggaguacaccaaacaccuuauucggguugaaaauuggaucuuucgcaaccccggauucgcacuggccgcugccgcgauugcaugguugcucggcagcaguacaucccagaaggugaucuaucuggucaugauacugcucaucgccccugcuuacucuauucgaugcaucggcgugagcaauagagauuuuguagaggggauguccggagguacuuggguugacauuguguuagaacauggcgggugugucaccgugauggcccaggauaagccaacaguggacaucgagcuggucaccacgacuguuucaaacauggcagaggugaggaguuacugcuaugaagcuagcauaucugauauggccuccgacucacggugucccacacaaggagaggcguaccuugacaaacagagcgauacccaguauguaugcaagcguacuuugguggaccgcggcugggguaauggguguggacuguucggcaaaggcagucuagucacaugcgccaaguuugcaugcucuaaaaagaugaccgggaaguccauucagccugaaaaccucgaguacagaaucaugcugagcgugcacggaucgcaacacucugguaugauuguuaaugauacgggccaugaaaccgacgagaacagggcuaaaguggagaucacaccaaauucaccccgggccgaagcuacucuugggggauucggcucccuggguuuggauugugagccucgaaccgggcucgacuuuagugaucuguauuacuuaacaaugaacaauaagcacuggcugguccauaaagaaugguuccacgacaucccacucccguggcacgccggcgcagauacuggaacaccccauuggaacaauaaggaggcccuuguggaauuuaaagacgcucacgcgaagcgccagaccguaguugugcugggcagccaggagggggcaguccauaccgccuuggcuggagcccuagaggcagaaauggauggugccaaaggcagacuguccucugggcaccucaagugcaggcugaagauggacaaacuucggcugaagggagugagcuauucauuguguacugcugccuucacguuuacaaaaauuccugcagagacccuccauggcacugucaccguggaaguucaguacgcggguacagacgggccaugcaaggugcccgcucaaauggccguagauaugcagacccugacuccugucggccgcuuaauaacagcaaacccagugaucacggagaguaccgaaaacuccaaaaugaugcuggagcuagaucccccguucggagacagcuacauuguuaucggcgugggggagaagaagauaacucaccacuggcauagaucuggaucaacaauugguaaagccuuugaagcuaccgucaggggcgccaagcguauggcagugcucggggacacagcuugggauuucggaaguguaggcggugcccugaauagccuugggaaaggcauccaccagaucuucggagcggccuuuaaguccuuguucggcgggaugucuugguuuucgcaaauucugaucggaacucuccugauguggcuuggccugaacaccaaaaaugguagcauuuccuugaugugucucgcuuuagggggagugcugauauuccugucaacggcaguuagugccgacugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8334 - RNA, 2308 nt, Artificial Sequence
  ZIKV prME variant mRNA Design 3 opt
gggagaaagcuuaccaugagaaggggcgccgacaccagcguggggaucgucggacugcuccuuacaacugcuauggcagccgagguuacgcggcgcgguuccgcguacuauauguaccuggaucgaaacgacgcuggcgaagccauuucuuuccccaccacauuggggaugaauaagugcuauauacagaucauggauuuaggacacaugugugacgcaacuaugucauacgagugcccuaugcuggaugaaggcguggagccagacgauguagacuguuggugcaacaccacaaguaccuggguggucuaugguacuugucaucacaaaaagggggaagcccguagaagcaggcgggcugugacacuaccgucccauucuacccgcaaacuccaaacgagaucgcagacuuggcuggagucaagggaguacaccaagcaccuuauucggguugaaaauuggaucuuucgcaaccccggauucgcacuggccgcugccgcgauugcaugguugcucggcagcaguacaucccagaaagugaucuaucuggucaugauacugcucaucgccccugcuuacucuauucgaugcaucggcgugagcaauagagauuuuguagaggggauguccggagguacuuggguugacauuguguuagaacauggcgggugugucaccgugauggcccaggauaagccaacaguggacaucgagcuggucaccacgacuguuucaaacauggcagaggugaggaguuacugcuaugaagcuagcauaucugauauggccuccgacucacggugucccacacaaggagaggcguaccuugacaagcagagcgauacccaguauguaugcaaacguacuuugguggaccgcggcugggguaauggguguggacuguucggcaagggcagucuagucacaugcgccaaauuugcaugcucuaagaaaaugaccgggaaguccauucagccugaaaaccucgaguacagaaucaugcugagcgugcacggaucgcaacacucugguaugauuguuaaugauacgggccaugaaaccgacgagaacagggcuaagguggagaucacaccaaauucaccccgggccgaagcuacucuugggggauucggcucccuggguuuggauugugagccucgaaccgggcucgacuuuagugaucuguauuacuuaacaaugaacaauaaacacuggcugguccauaaggaaugguuccacgacaucccacucccguggcacgccggcgcagauacuggaacaccccauuggaacaauaaagaggcccuuguggaauuuaaggacgcucacgcgaaacgccagaccguaguugugcugggcagccaggagggggcaguccauaccgccuuggcuggagcccuagaggcagaaauggauggugccaagggcagacuguccucugggcaccucaaaugcaggcugaagauggacaagcugcggcugaaaggagugagcuauucauuguguacugcugccuucacguuuacaaagauuccugcagagacccuccauggcacugucaccguggaaguucaguacgcggguacagacgggccaugcaaagugcccgcucaaauggccguagauaugcagacccugacuccugucggccgcuuaauaacagcaaacccagugaucacggagaguaccgaaaacuccaagaugaugcuggagcuagaucccccguucggagacagcuacauuguuaucggcgugggggagaaaaagauaacucaccacuggcauagaucuggaucaacaauugguaaggccuuugaagcuaccgucaggggcgccaaacguauggcagugcucggggacacagcuugggauuucggaaguguaggcggugcccugaauagccuugggaagggcauccaccagaucuucggagcggccuuuaaauccuuguucggcgggaugucuugguuuucgcaaauucugaucggaacucuccugauguggcuuggccugaacaccaagaaugguagcauuuccuugaugugucucgcucuugggggaguguuaauauuccugucaacggcaguuagugccgacugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8335 - RNA, 2305 nt, Artificial Sequence
  ZIKV prME variant mRNA Design 3 opt
gggagaaagcuuaccaugagaggcgccgacaccagcguggggaucgucggacugcuccuuacaacugcuauggcagccgagguuacgaggcgggguuccgcguacuauauguaccuggaucgcaacgacgcuggcgaagccauuucuuuccccaccacauuggggaugaauaagugcuauauacagaucauggauuuaggacacaugugugacgcaacuaugucauacgagugcccuaugcuggaugaaggcguggagccagacgauguagacuguuggugcaacaccacaaguaccuggguggucuaugguacuugucaucacaaaaagggggaagcccgacguagcagaagggcugugacacuaccgucccauucuacccggaaacuccaaacgcgcucgcagacuuggcuggagucaagagaguacaccaagcaccuuauuaggguugaaaauuggaucuuucggaaccccggauucgcacuggccgcugccgcgauugcaugguugcucggcagcaguacaucccagaaagugaucuaucuggucaugauacugcucaucgccccugcuuacucuauucgcugcaucggcgugagcaaucgagauuuuguagaggggauguccggagguacuuggguugacauuguguuagaacauggcgggugugucaccgugauggcccaggauaagccaacaguggacaucgagcuggucaccacgacuguuucaaacauggcagaggugagaaguuacugcuaugaagcuagcauaucugauauggccuccgacucaaggugucccacacaaggagaggcguaccuugacaagcagagcgauacccaguauguaugcaaacggacuuugguggaccguggcugggguaauggguguggacuguucggcaagggcagucuagucacaugcgccaaauuugcaugcucuaagaaaaugaccgggaaguccauucagccugaaaaccucgaguaccgcaucaugcugagcgugcacggaucgcaacacucugguaugauuguuaaugauacgggccaugaaaccgacgagaacagagcuaagguggagaucacaccaaauucccccagggccgaagcuacucuugggggauucggcucacuggguuuggauugugagccucggaccgggcucgacuuuagugaucuguauuacuuaacaaugaacaauaaacacuggcugguccauaaggaaugguuccacgacaucccacucccguggcacgccggcgcagauacuggaacaccccauuggaacaauaaagaggcccuuguggaauuuaaggacgcucacgcgaaacgacagaccguaguugugcugggcagccaggagggggcaguccauaccgccuuggcuggagcccuagaggcagaaauggauggugccaagggccgccuguccucugggcaccucaaaugcagacugaagauggacaagcugaggcugaaaggagugagcuauucauuguguacugcugccuucacguuuacaaagauuccugcagagacccuccauggcacugucaccguggaaguucaguacgcggguacagacgggccaugcaaagugcccgcucaaauggccguagauaugcagacccugacuccugucggccgguuaauaacagcaaacccagugaucacggagaguaccgaaaacuccaagaugaugcuggagcuagaucccccguucggagacagcuacauuguuaucggcgugggggagaaaaagauaacucaccacuggcaucgcucuggaucaacaauugguaaggccuuugaagcuaccgucagaggcgccaaaaggauggcagugcucggggacacagcuugggauuucggaaguguaggcggugcccugaauagccuugggaagggcauccaccagaucuucggagcggccuuuaaauccuuguucggcgggaugucuugguuuucgcaaauucugaucggaacucuccugauguggcuuggccugaacaccaagaaugguagcauuuccuugaugugucucgcucuugggggaguguuaauauuccugucaacggcaguuagugccgacugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8336 - RNA, 2302 nt, Artificial Sequence
  ZIKV prME variant mRNA Design 3 opt
gggagaaagcuuaccaugggcgccgacaccagcguggggaucgucggacugcuccuuacaacugcuauggcagccgagguuacgagaagggguuccgcguacuauauguaccuggaucggaacgacgcuggcgaagccauuucuuuccccaccacauuggggaugaauaagugcuauauacagaucauggauuuaggacacaugugugacgcaacuaugucauacgagugcccuaugcuggaugaaggcguggagccagacgauguagacuguuggugcaacaccacaaguaccuggguggucuaugguacuugucaucacaaaaagggggaagcccgccgaagccguagagcugugacacuaccgucccauucuaccaggaaacuccaaacgcggucgcagacuuggcuggagucacgcgaguacaccaagcaccuuauuagaguugaaaauuggaucuuuaggaaccccggauucgcacuggccgcugccgcgauugcaugguugcucggcagcaguacaucccagaaagugaucuaucuggucaugauacugcucaucgccccugcuuacucuauucggugcaucggcgugagcaaucgcgauuuuguagaggggauguccggagguacuuggguugacauuguguuagaacauggcgggugugucaccgugauggcccaggauaagccaacaguggacaucgagcuggucaccacgacuguuucaaacauggcagaggugcgaaguuacugcuaugaagcuagcauaucugauauggccuccgacucaagaugucccacacaaggagaggcguaccuugacaagcagagcgauacccaguauguaugcaaaaggacuuugguggaccggggcugggguaauggguguggacuguucggcaagggcagucuagucacaugcgccaaauuugcaugcucuaagaaaaugaccgggaaguccauucagccugaaaaccucgaguaccguaucaugcugagcgugcacggaucgcaacacucugguaugauuguuaaugauacgggccaugaaaccgacgagaaccgcgcuaagguggagaucacaccaaauucccccagagccgaagcuacucuugggggauucggcucacuggguuuggauugugagccuaggaccgggcucgacuuuagugaucuguauuacuuaacaaugaacaauaaacacuggcugguccauaaggaaugguuccacgacaucccacucccguggcacgccggcgcagauacuggaacaccccauuggaacaauaaagaggcccuuguggaauuuaaggacgcucacgcgaaacggcagaccguaguugugcugggcagccaggagggggcaguccauaccgccuuggcuggagcccuagaggcagaaauggauggugccaagggccgacuguccucugggcaccucaaaugccgccugaagauggacaagcugagacugaaaggagugagcuauucauuguguacugcugccuucacguuuacaaagauuccugcagagacccuccauggcacugucaccguggaaguucaguacgcggguacagacgggccaugcaaagugcccgcucaaauggccguagauaugcagacccugacuccugucggcagguuaauaacagcaaacccagugaucacggagaguaccgaaaacuccaagaugaugcuggagcuagaucccccguucggagacagcuacauuguuaucggcgugggggagaaaaagauaacucaccacuggcaucggucuggaucaacaauugguaaggccuuugaagcuaccguccgcggcgccaaaagaauggcagugcucggggacacagcuugggauuucggaaguguaggcggugcccugaauagccuugggaagggcauccaccagaucuucggagcggccuuuaaauccuuguucggcgggaugucuugguuuucgcaaauucugaucggaacucuccugauguggcuuggccugaacaccaagaaugguagcauuuccuugaugugucucgcucuugggggaguguuaauauuccugucaacggcaguuagugccgacugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8337 - RNA, 2299 nt, Artificial Sequence
  ZIKV prME variant mRNA Design 3 opt
gggagaaagcuuaccauggccgacaccagcgugggcaucgucgggcugcuccuuacaacugcuauggcagccgagguuacgagaaggggauccgcguacuauauguaccuggaucggaacgacgcuggugaagccauuucuuuccccaccacauugggcaugaauaagugcuauauacagaucauggauuuagggcacaugugugacgcaacuaugucauacgagugcccuaugcuggaugaaggaguggagccagacgauguagacuguuggugcaacaccacaaguaccuggguggucuauggcacuugucaucacaaaaagggugaagcccgccgaagccguagagcugugacacuaccgucccauucuaccaggaaacuccaaacgcggucgcagacuuggcuggagucacgcgaguacaccaagcaccuuauuagaguugaaaauuggaucuuuaggaaccccggguucgcacuggccgcugccgcgauugcaugguugcucggaagcaguacaucccagaaagugaucuaucuggucaugauacugcucaucgccccugcuuacucuauucggugcaucggcgugagcaaucgcgauuuuguagagggcauguccgggggaacuuggguugacauuguguuagaacaugguggcugugucaccgugauggcccaggauaagccaacaguggacaucgagcuggucaccacgacuguuucaaacauggcagaggugcgaaguuacugcuaugaagcuagcauaucugauauggccuccgacucaagaugucccacacaaggggaggcguaccuugacaagcagagcgauacccaguauguaugcaaaaggacuuugguggaccggggauggggcaaugguugugggcuguucggaaagggcagucuagucacaugcgccaaauuugcaugcucuaagaaaaugaccggcaaguccauucagccugaaaaccucgaguaccguaucaugcugagcgugcacgggucgcaacacucuggaaugauuguuaaugauacgggucaugaaaccgacgagaaccgcgcuaagguggagaucacaccaaauucccccagagccgaagcuacucuuggcggguucggaucacugggcuuggauugugagccuaggaccggucucgacuuuagugaucuguauuacuuaacaaugaacaauaaacacuggcugguccauaaggaaugguuccacgacaucccacucccguggcacgccggggcagauacuggcacaccccauuggaacaauaaagaggcccuuguggaauuuaaggacgcucacgcgaaacggcagaccguaguugugcugggaagccaggagggcgcaguccauaccgccuuggcuggggcccuagaggcagaaauggauggagccaagggucgacuguccucuggccaccucaaaugccgccugaagauggacaaacuuagacugaagggggugagcuauucauuguguacugcugccuucacguuuacaaagauuccugcagagacccuccauggaacugucaccguggaaguucaguacgcgggcacagacgguccaugcaaagugcccgcucaaauggccguagauaugcagacccugacuccugucgggagguuaauaacagcaaacccagugaucacggagaguaccgaaaacuccaagaugaugcuggagcuagaucccccguucggcgacagcuacauuguuaucggagugggcgagaaaaagauaacucaccacuggcaucggucugggucaacaauuggaaaggccuuugaagcuaccguccgcggugccaaaagaauggcagugcucggcgacacagcuugggauuucgggaguguaggaggcgcccugaauagccuugguaaggggauccaccagaucuucggcgcggccuuuaaauccuuguucggaggcaugucuugguuuucgcaaauucugaucgggacucuccugauguggcuuggacugaacaccaagaauggcagcauuuccuugaugugucucgcucugggugggguguuaauauuccugucaacggcaguuagugccgacugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8338 - RNA, 2296 nt, Artificial Sequence
  ZIKV prME variant mRNA Design 3 opt
gggagaaagcuuaccauggacaccagcgugggcaucgucgggcugcuccuuacaacugccauggcugcagagguuacgagaaggggauccgccuacuauauguaccuggaucggaacgacgcgggugaagcuauuucuuuccccaccacauugggcaugaauaagugcuauauacagaucauggauuuagggcacaugugugacgccacuaugucauacgagugcccuaugcuggaugaaggaguggagccagacgauguagacuguuggugcaacaccacaaguaccuggguggucuauggcacuugucaucacaaaaagggugaagcacgccgaagccguagagccgugacacuaccgucccauucuaccaggaaacuccaaacgcggucgcagacuuggcuggagucacgcgaguacaccaagcaccuuauuagaguugaaaauuggaucuuuaggaaccccggguucgcucuggcagccgcugccauugcgugguugcucggaagcaguacaucccagaaagugaucuaucuggucaugauacugcucaucgcacccgccuacucuauucggugcaucggcgugagcaaucgcgauuuuguagagggcauguccgggggaacuuggguugacauuguguuagaacaugguggcugugucaccgugauggcucaggauaagccaacaguggacaucgagcuggucaccacgacuguuucaaacauggccgaggugcgaaguuacugcuaugaagcaagcauaucugauauggcuuccgacucaagaugucccacacaaggggaggccuaccuugacaagcagagcgauacccaguauguaugcaaaaggacuuugguggaccggggauggggcaaugguugugggcuguucggaaagggcagucuagucacaugcgcgaaauuugccugcucuaagaaaaugaccggcaaguccauucagccugaaaaccucgaguaccguaucaugcugagcgugcacgggucgcaacacucuggaaugauuguuaaugauacgggucaugaaaccgacgagaaccgcgcaaagguggagaucacaccaaauucccccagagcugaagccacucuuggcggguucggaucacugggcuuggauugugagccuaggaccggucucgacuuuagugaucuguauuacuuaacaaugaacaauaaacacuggcugguccauaaggaaugguuccacgacaucccacucccguggcacgcuggggccgauacuggcaccccucauuggaacaauaaagaggcacuuguggaauuuaaggacgcccacgcuaaacggcagacaguaguugugcugggaagccaggagggcgcgguccauaccgcauuggccggggcucuagaggccgaaauggauggagcaaagggucgacuguccucuggccaccucaaaugccgccugaagauggacaaacuuagacugaagggggugagcuauucauuguguacugccgcuuucacguuuacaaagauuccugccgagacccuccauggaacugucaccguggaaguucaguacgcaggcacagacgguccaugcaaagugcccgcgcaaauggcuguagauaugcagacccugacuccugucgggagguuaauaacagccaacccagugaucacggagaguaccgaaaacuccaagaugaugcuggagcuagaucccccguucggcgacagcuacauuguuaucggagugggcgagaaaaagauaacucaccacuggcaucggucugggucaacaauuggaaaggcauuugaagccaccguccgcggugcuaaaagaauggccgugcucggcgacacagcaugggauuucgggaguguaggaggcgcucugaauagccuugguaaggggauccaccagaucuucggcgccgcguuuaaauccuuguucggaggcaugucuugguuuucgcaaauucugaucgggacucuccugauguggcuuggacugaacaccaagaauggcagcauuuccuugaugugucucgcccugggugggguguuaauauuccugucaacggcuguuagugcagacugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8339 - RNA, 2293 nt, Artificial Sequence
  ZIKV prME variant mRNA Design 3 opt
gggagaaagcuuaccaugaccagcgugggcaucgucgggcugcuccuuacaacugccauggcugcagagguuacgagaaggggauccgccuacuauauguaccuggaccggaacgaugcgggugaagcuauuucuuuccccaccacauugggcaugaauaagugcuauauacagaucauggacuuagggcacaugugugaugccacuaugucauacgagugcccuaugcuggacgaaggaguggagccagaugacguagauuguuggugcaacaccacaaguaccuggguggucuauggcacuugucaucacaaaaagggugaagcacgccgaagccguagagccgugacacuaccgucccauucuaccaggaaacuccaaacgcggucgcagacuuggcuggagucacgcgaguacaccaagcaccuuauuagaguugaaaauuggaucuuuaggaaccccggguucgcucuggcagccgcugccauugcgugguugcucggaagcaguacaucccagaaagugaucuaucuggucaugauacugcucaucgcacccgccuacucuauucggugcaucggcgugagcaaucgcgacuuuguagagggcauguccgggggaacuuggguugauauuguguuagaacaugguggcugugucaccgugauggcucaggacaagccaacaguggauaucgagcuggucaccacgacuguuucaaacauggccgaggugcgaaguuacugcuaugaagcaagcauaucugacauggcuuccgauucaagaugucccacacaaggggaggccuaccuugacaagcagagcgacacccaguauguaugcaaaaggacuuugguggaucggggauggggcaaugguugugggcuguucggaaagggcagucuagucacaugcgcgaaauuugccugcucuaagaaaaugaccggcaaguccauucagccugaaaaccucgaguaccguaucaugcugagcgugcacgggucgcaacacucuggaaugauuguuaaugacacgggucaugaaaccgaugagaaccgcgcaaagguggagaucacaccaaauucccccagagcugaagccacucuuggcggguucggaucacugggcuuggacugugagccuaggaccggucucgauuuuagugaccuguauuacuuaacaaugaacaauaaacacuggcugguccauaaggaaugguuccacgauaucccacucccguggcacgcuggggccgacacuggcaccccucauuggaacaauaaagaggcacuuguggaauuuaaggaugcccacgcuaaacggcagacaguaguugugcugggaagccaggagggcgcgguccauaccgcauuggccggggcucuagaggccgaaauggacggagcaaagggucgacuguccucuggccaccucaaaugccgccugaagauggauaaacuuagacugaagggggugagcuauucauuguguacugccgcuuucacguuuacaaagauuccugccgagacccuccauggaacugucaccguggaaguucaguacgcaggcacagacgguccaugcaaagugcccgcgcaaauggcuguagacaugcagacccugacuccugucgggagguuaauaacagccaacccagugaucacggagaguaccgaaaacuccaagaugaugcuggagcuagaucccccguucggcgacagcuacauuguuaucggagugggcgagaaaaagauaacucaccacuggcaucggucugggucaacaauuggaaaggcauuugaagccaccguccgcggugcuaaaagaauggccgugcucggcgauacagcaugggacuucgggaguguaggaggcgcucugaauagccuugguaaggggauccaccagaucuucggcgccgcguuuaaauccuuguucggaggcaugucuugguuuucgcaaauucugaucgggacucuccugauguggcuuggacugaacaccaagaauggcagcauuuccuugaugugucucgcccugggugggguguuaauauuccugucaacggcuguuagugcagauugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8340 - RNA, 2293 nt, Artificial Sequence
  ZIKV prME variant mRNA Design 3 opt
gggagaaagcuuaccaugaccagcgugggcaucgucgggcugcuccuuacaacugccauggcugcagccguuacgagaaggggauccgcguacuauauguaccuggaccggaacgaugcuggugaggccauuucuuuccccaccacauugggcaugaauaagugcuauauacagaucauggacuuagggcacaugugugaugcaacuaugucauacgaaugcccuaugcuggacgagggaguggaaccagaugacguagauuguuggugcaacaccacaaguaccuggguggucuauggcacuugucaucacaaaaagggugaggcccgccgaagccguagagcugugacacuaccgucccauucuaccaggaaacuccaaacgcggucgcagacuuggcuggaaucacgcgaguacaccaagcaccuuauuagaguugagaauuggaucuuuaggaaccccggguucgcacuggccgcugccgcgauugcaugguugcucggaagcaguacaucccagaaagugaucuaucuggucaugauacugcucaucgccccugcuuacucuauucggugcaucggcgugagcaaucgcgacuuuguagaaggcauguccgggggaacuuggguugauauuguguuagagcaugguggcugugucaccgugauggcccaggacaagccaacaguggauaucgaacuggucaccacgacuguuucaaacauggcagaggugcgaaguuacugcuaugaggcuagcauaucugacauggccuccgauucaagaugucccacacaaggggaagcguaccuugacaagcagagcgacacccaguauguaugcaaaaggacuuugguggaucggggauggggcaaugguugugggcuguucggaaagggcagucuagucacaugcgccaaauuugcaugcucuaagaaaaugaccggcaaguccauucagccugagaaccucgaauaccguaucaugcugagcgugcacgggucgcaacacucuggaaugauuguuaaugacacgggucaugagaccgaugaaaaccgcgcuaagguggagaucacaccaaauucccccagagccgaggcuacucuuggcggguucggaucacugggcuuggacugugaaccuaggaccggucucgauuuuagugaccuguauuacuuaacaaugaacaauaaacacuggcugguccauaaggagugguuccacgauaucccacucccguggcacgccggggcagacacuggcacaccccauuggaacaauaaagaagcccuuguggaguuuaaggaugcucacgcgaaacggcagaccguaguugugcugggaagccaggaaggcgcaguccauaccgccuuggcuggggcccuagaggcagagauggacggagccaagggucgacuguccucuggccaccucaaaugccgccugaagauggauaaacuuagacugaagggggugagcuauucauuguguacugcugccuucacguuuacaaagauuccugcagaaacccuccauggaacugucaccguggagguucaguacgcgggcacagacgguccaugcaaagugcccgcucaaauggccguagacaugcagacccugacuccugucgggagguuaauaacagcaaacccagugaucacggaaaguaccgagaacuccaagaugaugcuggaacuagaucccccguucggcgacagcuacauuguuaucggagugggcgagaaaaagauaacucaccacuggcaucggucugggucaacaauuggaaaggccuuugaggcuaccguccgcggugccaaaagaauggcagugcucggcgauacagcuugggacuucgggaguguaggaggcgcccugaauagccuugguaaggggauccaccagaucuucggcgcggccuuuaaauccuuguucggaggcaugucuugguuuucgcaaauucugaucgggacucuccugauguggcuuggacugaacaccaagaauggcagcauuuccuugaugugucucgcucugggugggguguuaauauuccugucaacggcaguuagugccgauugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8341 - RNA, 2305 nt, Artificial Sequence
  ZIKV prME variant mRNA Design 3 opt
gggagaaagcuuaccaugagaggcgccgacaccagcguggggaucgucggacugcuccuuacaacugcuauggcagccgcgguuacgaggcgggguuccgcuuacuauauguaccuggaucgcaacgacgccggcgaggcaauuucuuuccccaccacauuggggaugaauaagugcuauauacagaucauggauuuaggacacaugugugacgccacuaugucauacgaaugcccuaugcuggaugagggcguggaaccagacgauguagacuguuggugcaacaccacaaguaccuggguggucuaugguacuugucaucacaaaaagggggaggcucgacguagcagaagggcagugacacuaccgucccauucuacccggaaacuccaaacgcgcucgcagacuuggcuggaaucaagagaguacaccaagcaccuuauuaggguugagaauuggaucuuucggaaccccggauucgcccuggcugccgcggcaauugccugguugcucggcagcaguacaucccagaaagugaucuaucuggucaugauacugcucaucgcuccugccuacucuauucgcugcaucggcgugagcaaucgagauuuuguagaagggauguccggagguacuuggguugacauuguguuagagcauggcgggugugucaccgugauggcacaggauaagccaacaguggacaucgaacuggucaccacgacuguuucaaacauggcugaggugagaaguuacugcuaugaggccagcauaucugauauggcguccgacucaaggugucccacacaaggagaagccuaccuugacaagcagagcgauacccaguauguaugcaaacggacuuugguggaccguggcugggguaauggguguggacuguucggcaagggcagucuagucacaugcgcaaaauuugcuugcucuaagaaaaugaccgggaaguccauucagccugagaaccucgaauaccgcaucaugcugagcgugcacggaucgcaacacucugguaugauuguuaaugauacgggccaugagaccgacgaaaacagagccaagguggagaucacaccaaauucccccagggcugaggccacucuugggggauucggcucacuggguuuggauugugaaccucggaccgggcucgacuuuagugaucuguauuacuuaacaaugaacaauaaacacuggcugguccauaaggagugguuccacgacaucccacucccguggcacgcaggcgccgauacuggaacaccccauuggaacaauaaagaagcucuuguggaguuuaaggacgcgcacgcaaaacgacagaccguaguugugcugggcagccaggaaggggccguccauaccgcuuuggccggagcacuagaggccgagauggauggugcuaagggccgccuguccucugggcaccucaaaugcagacugaagauggacaagcugaggcugaaaggagugagcuauucauuguguacugccgcauucacguuuacaaagauuccugcggaaacccuccauggcacugucaccguggagguucaguacgcugguacagacgggccaugcaaagugcccgcccaaauggcaguagauaugcagacccugacuccugucggccgguuaauaacagccaacccagugaucacggaaaguaccgagaacuccaagaugaugcuggaacuagaucccccguucggagacagcuacauuguuaucggcgugggggagaaaaagauaacucaccacuggcaucgcucuggaucaacaauugguaaggcuuuugaggccaccgucagaggcgcaaaaaggauggcugugcucggggacacagccugggauuucggaaguguaggcggugcgcugaauagccuugggaagggcauccaccagaucuucggagccgcuuuuaaauccuuguucggcgggaugucuugguuuucgcaaauucugaucggaacucuccugauguggcuuggccugaacaccaagaaugguagcauuuccuugaugugucucgcacuugggggaguguuaauauuccugucaacggccguuagugcugacugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8342 - RNA, 2329 nt, Artificial Sequence
  ZIKV prME variant mRNA Design 3 opt
gggagaaagcuuaccaugagaggccugagcuccaggaagcggcgcucucacgacgugcucaccguccaguuccuuauccuggggauguuguuaaugacaggagguguuacucgacguggcucagccuacuauauguaccuggauagaaacgacgcuggggaggcaauuaguuuucccacgacccuaggaaugaauaaaugcuauauacaaaucauggaucucggccauaugugugacgccacaaugagcuacgaaugcccuaugcuggaugaggguguggaaccagacgauguagacuguuggugcaacacuaccuccacauggguggucuaugggaccugucaccauaagaaaggagaggcgaggcggucucgcagagcugugacucuuccgucgcacucaacaaggaagcugcagacccggagccagacgugguuggaaagucgcgaguacacuaaacaucucauucgaguugagaauuggaucuucagaaaccccggcuuugcccuggcagccgcugcaauugccuggcugcucggcuccucuaccagccagaaggugaucuauuuagucaugauacugcuuaucgcuccugccuacuccauuaggugcaucggggugucaaaucgggauuucguagaaggaaugagugguggcacauggguugacauuguguuggagcacgggggaugugucacugugauggcgcaagauaagccaaccguggacaucgaacuggucacaaccacgguuagcaacauggcagaggugcguucuuacugcuaugaggccuccauaucagauauggcuagcgacagucgcugucccacucagggcgaagccuaccuagacaaacagucugauacacaguauguaugcaagagaacccucguggacagggguugggggaauggauguggccuguuuggcaaagggucccuugucacuugcgcaaaguucgcuugcagcaaaaagaugacaggaaagucgauucaaccugagaaccuggaauaccggaucauguugucugugcacgguucccagcauucaggcaugauuguuaaugauaccgggcacgagacggacgaaaaccgagccaaaguggagaucaccccaaauaguccccgcgcggaggccacacucggaggcuuugguagccugggguuagauugugaaccuagaacuggccuggacuucuccgaucucuauuaccuuaccaugaacaauaagcauuggcugguccacaaagagugguuucacgacaucccauugccguggcaugcaggagcugauacaggcacuccccacuggaacaauaaggaagcccuaguggaguucaaagacgcucaugccaagaggcagaccguaguugugcuggggucucaggaaggagcaguccacacagcccucgcuggugcgcuggaggcagagauggauggcgccaaagggcggcuuagcucaggacaucugaagugccgcuugaagauggacaaacucagacugaagggcgugaguuauuccuuauguaccgcugccuuuacuuucacgaaaauuccugcagaaacacugcacgguaccgucacuguggagguucaauacgccgggaccgacggcccaugcaaggugcccgcucagauggccguagauaugcagacacuaaccccugucggaaggcucauaacugcaaacccagugaucacagaaagcacggagaacucuaaaaugaugcuggaacuugaucccccguuuggcgacucauacauuguuaucggggugggagagaagaagauaacccaccauuggcaccguagugguagcacuauuggcaaagcguucgaggcuacaguccgaggggccaagcggauggcaguguugggagacaccgccugggauuucggcuccguagguggggcucucaauucucugggcaaaggaauccaucaaaucuuuggcgccgcauucaagucgcuguuugggggaaugagcugguucucccagauucuuaucggcacacuguugauguggcucggucugaacacuaaaaaugggucaauuaguuuaaugugucuggcucuaggaggcgugcucauauuucugucuaccgccguuagcgcggacugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8343 - RNA, 2329 nt, Artificial Sequence
  ZIKV prME variant mRNA Design 3 opt
gggagaaagcuuaccaugagaggccugagcuccaggaagcggcgcucucacgacgugcucaccguccaguuccuuauccuggggauguuguuaaugacaggagccguuacucgacgugguucagcuuacuauauguaccuggauagaaacgacgcaggcgaggccauuaguuuucccacgacccuagggaugaauaaaugcuauauacaaaucauggaucucggacauaugugugacgcgacaaugagcuacgaaugcccuaugcuggaugagggcguggaaccagacgauguagacuguuggugcaacacuaccuccacauggguggucuaugguaccugucaccauaagaaaggggaggcuaggcggucucgcagagccgugacucuuccgucgcacucaacaaggaagcugcagacccggagccagacgugguuggaaagucgcgaguacacuaaacaucucauucgaguugagaauuggaucuucagaaaccccggauuugcacuggccgcugcagccauugcuuggcugcucggcuccucuaccagccagaaggugaucuauuuagucaugauacugcuuaucgccccugcguacuccauuaggugcaucggcgugucaaaucgggauuucguagaagggaugaguggagguacauggguugacauuguguuggagcacggcgggugugucacugugauggcacaagauaagccaaccguggacaucgaacuggucacaaccacgguuagcaacauggccgaggugcguucuuacugcuaugaggcuuccauaucagauauggccagcgacagucgcugucccacucagggagaagcauaccuagacaaacagucugauacacaguauguaugcaagagaacccucguggacaggggcugggguaauggguguggacuguuuggcaaaggcucccuugucacuugcgcuaaguucgccugcagcaaaaagaugacagggaagucgauucaaccugagaaccuggaauaccggaucauguugucugugcacggaucccagcauucagguaugauuguuaaugauaccggccacgagacggacgaaaaccgagcgaaaguggagaucaccccaaauaguccccgcgccgaggcaacacucgggggauuuggcagccuggguuuagauugugaaccuagaacugggcuggacuucuccgaucucuauuaccuuaccaugaacaauaagcauuggcugguccacaaagagugguuucacgacaucccauugccguggcaugcuggcgccgauacaggaacuccccacuggaacaauaaggaagcucuaguggaguucaaagacgcccaugcaaagaggcagaccguaguugugcugggcucucaggaaggggccguccacacagcucucgcgggagcacuggaggccgagauggauggugcuaaaggccggcuuagcucagggcaucugaagugccgcuugaagauggacaaacucagacugaagggagugaguuauuccuuauguaccgccgcauuuacuuucacgaaaauuccugccgaaacacugcacggcaccgucacuguggagguucaauacgcugguaccgacgggccaugcaaggugcccgcccagauggcaguagauaugcagacacuaaccccugucggcaggcucauaacugcgaacccagugaucacagaaagcacggagaacucuaaaaugaugcuggaacuugaucccccguuuggagacucauacauuguuaucggcgugggggagaagaagauaacccaccauuggcaccguaguggaagcacuauugguaaggcuuucgaggccacaguccggggcgcaaaacgaauggccguguugggggacaccgcuugggauuucggauccguaggcggugcccucaauucucuggggaaaggcauccaucaaaucuuuggagcagcuuucaagucgcuguuuggcgggaugagcugguucucccagauucuuaucggaacacuguugauguggcucggccugaacacuaaaaaugguucaauuaguuuaaugugucuggcccuagggggagugcucauauuucugucuaccgcgguuagcgccgacugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8344 - RNA, 2335 nt, Artificial Sequence
  ZIKV prME variant mRNA Design 3 opt
gggagaaagcuuaccaugagaaucauuaacgccaggaaggagaaaaagcggcgcggcgcugacaccagcguggggauagucggacugcuccuuacaacugcaauggccgcggaaguuacgcgacgugguuccgcuuacuauauguaccuggauagaaaugacgccggcgaggcaaucucuuuccccaccacauuggggaugaacaaaugcuauauucagaucauggauuuaggacacaugugugacgccacuaugucauacgaaugcccuaugcuggaugagggcguggaaccagacgauguagacuguuggugcaauaccacaaguaccuggguggucuaugguacuugucaucacaagaaaggggaggcuaggcggagccgcagagcagugacacuaccgucccauucuaccaggaagcuccaaacgcggucgcagacuuggcuggagucacgcgaauacaccaagcaccuuauucgaguugagaacuggaucuuuagaaaucccggauucgcccuggcugccgcggcaauagccugguugcucggcagcaguacaucccagaaagugaucuaucuggucaugauucugcucaucgcuccugccuacucuauuaggugcaucggcgugagcaaccgggauuuuguagaagggauguccggagguacuuggguugacauaguguuagagcauggcgggugugucaccgugauggcacaggauaagccaacaguggacauugagcuggucaccacgacuguuucaaauauggcugaagugcguaguuacugcuaugaggccagcaucucugauauggcguccgacucacgcugucccacacaaggagaagccuaccuugacaaacagagcgauacccaguauguaugcaagagaacuuugguggacaggggcugggguaacggguguggacuguucggcaaaggcagucuagucacaugcgcaaaguuugcuugcucuaagaaaaugaccgggaaguccauucagccugagaaucucgaauaccggaucaugcugagcgugcacggaucgcaacacucugguaugaucguuaacgauacgggccaugagaccgacgagaaucgagccaaaguggaaauuacaccaaacucaccccgcgcugaggccacucuugggggauucggcucccuggguuuggauugugaaccuagaaccgggcucgacuuuagugaucuguauuacuuaacaaugaauaacaagcacuggcugguccauaaagagugguuccacgacauaccacucccguggcacgcaggcgccgauacuggaacaccccauuggaauaacaaggaagcucuuguggaguuuaaagacgcgcacgcaaagaggcagaccguaguugugcugggcagccaggagggggccguccauaccgcuuuggccggagcacuagaagccgagauggauggugcuaagggccggcuguccucugggcaccucaaaugccgccugaagauggacaaacuuagacugaagggagugagcuauucauuguguacugccgcauucacguuuacaaaaaucccugcggaaacccuccauggcacugucaccguggagguucaguacgcugguacagacgggccaugcaaggugcccgcccaaauggcaguagauaugcagacccugacuccugucggcagguuaauuacagccaacccagugaucacggaaaguaccgaaaauuccaagaugaugcuggagcuagaucccccguucggagacagcuacauaguuauuggcgugggggagaaaaagaucacucaccacuggcaucguucuggaucaacaaucgguaaggcuuuugaggccaccguccggggcgcaaaacgaauggcugugcucggggacacagccugggauuucggaaguguaggcggugcgcugaacagccuugggaaaggcauucaccagaucuucggagccgcuuuuaaguccuuguucggcgggaugucuugguuuucgcaaauucugauaggaacucuccugauguggcuuggccugaauaccaagaacgguagcaucuccuugaugugucucgcauuagggggagugcugauuuuccugucaacggccguuagugcuugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8345 - RNA, 2329 nt, Artificial Sequence
  ZIKV prME variant mRNA Design 3 opt
gggagaaagcuuaccaugaucaacgccagaaaggagaaaaagaggcggggcgcugacaccagcguggggauugucggacugcuccuuacaacugcaauggccgcggaaguuacgcgccgagguuccgcuuacuauauguaccuggaucguaaugacgccggcgaggcaauaucuuuccccaccacauuggggaugaacaaaugcuauauccagauuauggauuuaggacacaugugugacgccacuaugucauacgaaugcccuaugcuggaugagggcguggaaccagacgauguagacuguuggugcaauaccacaaguaccuggguggucuaugguacuugucaucacaagaaaggggaggcuagaaggagccggcgcgcagugacacuaccgucccauucuaccagaaagcuccaaacgaggucgcagacuuggcuggagucacgggaauacaccaagcaccuuauccgcguugagaacuggauuuuucgaaaucccggauucgcccuggcugccgcggcaaucgccugguugcucggcagcaguacaucccagaaagugauauaucuggucaugauccugcucauugcuccugccuacucuaucagaugcauuggcgugagcaacagggauuuuguagaagggauguccggagguacuuggguugacaucguguuagagcauggcgggugugucaccgugauggcacaggauaagccaacaguggacauagagcuggucaccacgacuguuucaaauauggcugaagugcggaguuacugcuaugaggccagcauuucugauauggcguccgacucacguugucccacacaaggagaagccuaccuugacaaacagagcgauacccaguauguaugcaagcgcacuuugguggacagaggcugggguaacggguguggacuguucggcaaaggcagucuagucacaugcgcaaaguuugcuugcucuaagaaaaugaccgggaaguccauccagccugagaaucucgaauacaggauuaugcugagcgugcacggaucgcaacacucugguaugaucguuaacgauacgggccaugagaccgacgagaaucgggccaaaguggaaaucacaccaaacucaccccgagcugaggccacucuugggggauucggcucccuggguuuggauugugaaccucgcaccgggcucgacuuuagugaucuguauuacuuaacaaugaauaacaagcacuggcugguccauaaagagugguuccacgacauuccacucccguggcacgcaggcgccgauacuggaacaccccauuggaauaacaaggaagcucuuguggaguuuaaagacgcgcacgcaaagagacagaccguaguugugcugggcagccaggagggggccguccauaccgcuuuggccggagcacuagaagccgagauggauggugcuaagggcaggcuguccucugggcaccucaaaugccggcugaagauggacaaacuucgccugaagggagugagcuauucauuguguacugccgcauucacguuuacaaaaauaccugcggaaacccuccauggcacugucaccguggagguucaguacgcugguacagacgggccaugcaaggugcccgcccaaauggcaguagauaugcagacccugacuccugucggcagauuaaucacagccaacccagugauuacggaaaguaccgaaaauuccaagaugaugcuggagcuagaucccccguucggagacagcuacaucguuauaggcgugggggagaaaaagauuacucaccacuggcauaggucuggaucaacaaucgguaaggcuuuugaggccaccguccguggcgcaaaacggauggcugugcucggggacacagccugggauuucggaaguguaggcggugcgcugaacagccuugggaaaggcauccaccagauuuucggagccgcuuuuaaguccuuguucggcgggaugucuugguuuucgcaaauccugauuggaacucuccugauguggcuuggccugaauaccaagaacgguagcauauccuugaugugucucgcauuagggggagugcugaucuuccugucaacggccguuagugcuugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8346 - RNA, 2332 nt, Artificial Sequence
  ZIKV prME variant mRNA Design 3 opt
gggagaaagcuuaccaugaucauuaacgccagaaaggagaaaaagaggcggggcgcugacaccagcguggggauagucggacugcuccuuacaacugcaauggccgcggaaguuacgcgccgagguuccgcuuacuauauguaccuggaucguaaugacgccggcgaggcaaucucuuuccccaccacauuggggaugaacaaaugcuauauucagaucauggauuuaggacacaugugugacgccacuaugucauacgaaugcccuaugcuggaugagggcguggaaccagacgauguagacuguuggugcaauaccacaaguaccuggguggucuaugguacuugucaucacaagaaaggggaggcuagaaggagccggcgcgcagugacacuaccgucccauucuaccagaaagcuccaaacgaggucgcagacuuggcuggagucacgggaauacaccaagcaccuuauucgcguugagaacuggaucuuucgaaaucccggauucgcccuggcugccgcggcaauagccugguugcucggcagcaguacaucccagaaagugaucuaucuggucaugauucugcucaucgcuccugccuacucuauuagaugcaucggcgugagcaacagggauuuuguagaagggauguccggagguacuuggguugacauaguguuagagcauggcgggugugucaccgugauggcacaggauaagccaacaguggacauugagcuggucaccacgacuguuucaaauauggcugaagugcggaguuacugcuaugaggccagcaucucugauauggcguccgacucacguugucccacacaaggagaagccuaccuugacaaacagagcgauacccaguauguaugcaagcgcacuuugguggacagaggcugggguaacggguguggacuguucggcaaaggcagucuagucacaugcgcaaaguuugcuugcucuaagaaaaugaccgggaaguccauucagccugagaaucucgaauacaggaucaugcugagcgugcacggaucgcaacacucugguaugaucguuaacgauacgggccaugagaccgacgagaaucgggccaaaguggaaauuacaccaaacucaccccgagcugaggccacucuugggggauucggcucccuggguuuggauugugaaccucgcaccgggcucgacuuuagugaucuguauuacuuaacaaugaauaacaagcacuggcugguccauaaagagugguuccacgacauaccacucccguggcacgcaggcgccgauacuggaacaccccauuggaauaacaaggaagcucuuguggaguuuaaagacgcgcacgcaaagagacagaccguaguugugcugggcagccaggagggggccguccauaccgcuuuggccggagcacuagaagccgagauggauggugcuaagggcaggcuguccucugggcaccucaaaugccggcugaagauggacaaacuucgccugaagggagugagcuauucauuguguacugccgcauucacguuuacaaaaaucccugcggaaacccuccauggcacugucaccguggagguucaguacgcugguacagacgggccaugcaaggugcccgcccaaauggcaguagauaugcagacccugacuccugucggcagauuaauuacagccaacccagugaucacggaaaguaccgaaaauuccaagaugaugcuggagcuagaucccccguucggagacagcuacauaguuauuggcgugggggagaaaaagaucacucaccacuggcauaggucuggaucaacaaucgguaaggcuuuugaggccaccguccguggcgcaaaacggauggcugugcucggggacacagccugggauuucggaaguguaggcggugcgcugaacagccuugggaaaggcauucaccagaucuucggagccgcuuuuaaguccuuguucggcgggaugucuugguuuucgcaaauucugauaggaacucuccugauguggcuuggccugaauaccaagaacgguagcaucuccuugaugugucucgcauuagggggagugcugauuuuccugucaacggccguuagugcuugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8347 - RNA, 2326 nt, Artificial Sequence
  ZIKV prME variant mRNA Design 3 opt
gggagaaagcuuaccaugaacgccagaaaggagaaaaagaggcggggcgcugacaccagcguggggaucgucggacugcuccuuacaacugcaauggccgcggaaguuacgcgccgagguuccgcuuacuauauguaccuggaucguaaugacgccggcgaggcaauuucuuuccccaccacauuggggaugaacaaaugcuauauacagaucauggauuuaggacacaugugugacgccacuaugucauacgaaugcccuaugcuggaugagggcguggaaccagacgauguagacuguuggugcaauaccacaaguaccuggguggucuaugguacuugucaucacaagaaaggggaggcuagaaggagccggcgcgcagugacacuaccgucccauucuaccagaaagcuccaaacgaggucgcagacuuggcuggagucacgggaauacaccaagcaccuuauucgcguugagaacuggaucuuucgaaaucccggauucgcccuggcugccgcggcaauugccugguugcucggcagcaguacaucccagaaagugaucuaucuggucaugauacugcucaucgcuccugccuacucuauuagaugcaucggcgugagcaacagggauuuuguagaagggauguccggagguacuuggguugacauuguguuagagcauggcgggugugucaccgugauggcacaggauaagccaacaguggacaucgagcuggucaccacgacuguuucaaauauggcugaagugcggaguuacugcuaugaggccagcauaucugauauggcguccgacucacguugucccacacaaggagaagccuaccuugacaaacagagcgauacccaguauguaugcaagcgcacuuugguggacagaggcugggguaacggguguggacuguucggcaaaggcagucuagucacaugcgcaaaguuugcuugcucuaagaaaaugaccgggaaguccauucagccugagaaucucgaauacaggaucaugcugagcgugcacggaucgcaacacucugguaugauuguuaacgauacgggccaugagaccgacgagaaucgggccaaaguggaaaucacaccaaacucaccccgagcugaggccacucuugggggauucggcucccuggguuuggauugugaaccucgcaccgggcucgacuuuagugaucuguauuacuuaacaaugaauaacaagcacuggcugguccauaaagagugguuccacgacaucccacucccguggcacgcaggcgccgauacuggaacaccccauuggaauaacaaggaagcucuuguggaguuuaaagacgcgcacgcaaagagacagaccguaguugugcugggcagccaggagggggccguccauaccgcuuuggccggagcacuagaagccgagauggauggugcuaagggcaggcuguccucugggcaccucaaaugccggcugaagauggacaaacuucgccugaagggagugagcuauucauuguguacugccgcauucacguuuacaaaaauuccugcggaaacccuccauggcacugucaccguggagguucaguacgcugguacagacgggccaugcaaggugcccgcccaaauggcaguagauaugcagacccugacuccugucggcagauuaauaacagccaacccagugaucacggaaaguaccgaaaauuccaagaugaugcuggagcuagaucccccguucggagacagcuacauuguuaucggcgugggggagaaaaagauaacucaccacuggcauaggucuggaucaacaauugguaaggcuuuugaggccaccguccguggcgcaaaacggauggcugugcucggggacacagccugggauuucggaaguguaggcggugcgcugaacagccuugggaaaggcauccaccagaucuucggagccgcuuuuaaguccuuguucggcgggaugucuugguuuucgcaaauucugaucggaacucuccugauguggcuuggccugaauaccaagaacgguagcauuuccuugaugugucucgcauuagggggagugcugauauuccugucaacggccguuagugcuugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8348 - RNA, 2323 nt, Artificial Sequence
  ZIKV prME variant mRNA Design 3 opt
gggagaaagcuuaccauggccagaaaggagaaaaagaggcggggcgcugacaccagcguggggaucgucggacugcuccuuacaacugcaauggccgcggaaguuacgcgccgagguuccgcuuacuauauguaccuggaucguaacgacgccggcgaggcaauuucuuuccccaccacauuggggaugaauaaaugcuauauacagaucauggauuuaggacacaugugugacgccacuaugucauacgaaugcccuaugcuggaugagggcguggaaccagacgauguagacuguuggugcaacaccacaaguaccuggguggucuaugguacuugucaucacaagaaaggggaggcuagaaggagccggcgcgcagugacacuaccgucccauucuaccagaaagcuccaaacgaggucgcagacuuggcuggagucacgggaauacaccaagcaccuuauucgcguugagaauuggaucuuucgaaaccccggauucgcccuggcugccgcggcaauugccugguugcucggcagcaguacaucccagaaagugaucuaucuggucaugauacugcucaucgcuccugccuacucuauuagaugcaucggcgugagcaauagggauuuuguagaagggauguccggagguacuuggguugacauuguguuagagcauggcgggugugucaccgugauggcacaggauaagccaacaguggacaucgagcuggucaccacgacuguuucaaacauggcugaagugcggaguuacugcuaugaggccagcauaucugauauggcguccgacucacguugucccacacaaggagaagccuaccuugacaaacagagcgauacccaguauguaugcaagcgcacuuugguggacagaggcugggguaauggguguggacuguucggcaaaggcagucuagucacaugcgcaaaguuugcuugcucuaagaaaaugaccgggaaguccauucagccugagaaccucgaauacaggaucaugcugagcgugcacggaucgcaacacucugguaugauuguuaaugauacgggccaugagaccgacgagaaccgggccaaaguggaaaucacaccaaauucaccccgagcugaggccacucuugggggauucggcucccuggguuuggauugugaaccucgcaccgggcucgacuuuagugaucuguauuacuuaacaaugaacaauaagcacuggcugguccauaaagagugguuccacgacaucccacucccguggcacgcaggcgccgauacuggaacaccccauuggaacaauaaggaagcucuuguggaguuuaaagacgcgcacgcaaagagacagaccguaguugugcugggcagccaggagggggccguccauaccgcuuuggccggagcacuagaagccgagauggauggugcuaagggcaggcuguccucugggcaccucaaaugccggcugaagauggacaaacuucgccugaagggagugagcuauucauuguguacugccgcauucacguuuacaaaaauuccugcggaaacccuccauggcacugucaccguggagguucaguacgcugguacagacgggccaugcaaggugcccgcccaaauggcaguagauaugcagacccugacuccugucggcagauuaauaacagccaacccagugaucacggaaaguaccgagaacuccaagaugaugcuggagcuagaucccccguucggagacagcuacauuguuaucggcgugggggagaaaaagauaacucaccacuggcauaggucuggaucaacaauugguaaggcuuuugaagccaccguccguggcgcaaaacggauggcugugcucggggacacagccugggauuucggaaguguaggcggugcgcugaauagccuugggaaaggcauccaccagaucuucggagccgcuuuuaaguccuuguucggcgggaugucuugguuuucgcaaauucugaucggaacucuccugauguggcuuggccugaacaccaagaaugguagcauuuccuugaugugucucgcauuagggggagugcugauauuccugucaacggccguuagugcuugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8349 - RNA, 2320 nt, Artificial Sequence
  ZIKV prME variant mRNA Design 3 opt
gggagaaagcuuaccaugagaaaggagaaaaagaggcggggcgccgacaccagcguggggaucgucggacugcuccuuacaacugcuauggcagccgaaguuacgcgccgagguuccgcguacuauauguaccuggaucguaacgacgcuggcgaggccauuucuuuccccaccacauuggggaugaauaaaugcuauauacagaucauggauuuaggacacaugugugacgcaacuaugucauacgaaugcccuaugcuggaugagggcguggaaccagacgauguagacuguuggugcaacaccacaaguaccuggguggucuaugguacuugucaucacaagaaaggggaggccagaaggagccggcgcgcugugacacuaccgucccauucuaccagaaagcuccaaacgaggucgcagacuuggcuggagucacgggaauacaccaagcaccuuauucgcguugagaauuggaucuuucgaaaccccggauucgcacuggccgcugccgcgauugcaugguugcucggcagcaguacaucccagaaagugaucuaucuggucaugauacugcucaucgccccugcuuacucuauuagaugcaucggcgugagcaauagggauuuuguagaagggauguccggagguacuuggguugacauuguguuagagcauggcgggugugucaccgugauggcccaggauaagccaacaguggacaucgagcuggucaccacgacuguuucaaacauggcagaagugcggaguuacugcuaugaggcuagcauaucugauauggccuccgacucacguugucccacacaaggagaagcguaccuugacaaacagagcgauacccaguauguaugcaagcgcacuuugguggacagaggcugggguaauggguguggacuguucggcaaaggcagucuagucacaugcgccaaguuugcaugcucuaagaaaaugaccgggaaguccauucagccugagaaccucgaauacaggaucaugcugagcgugcacggaucgcaacacucugguaugauuguuaaugauacgggccaugagaccgacgagaaccgggcuaaaguggaaaucacaccaaauucaccccgagccgaggcuacucuugggggauucggcucccuggguuuggauugugaaccucgcaccgggcucgacuuuagugaucuguauuacuuaacaaugaacaauaagcacuggcugguccauaaagagugguuccacgacaucccacucccguggcacgccggcgcagauacuggaacaccccauuggaacaauaaggaagcccuuguggaguuuaaagacgcucacgcgaagagacagaccguaguugugcugggcagccaggagggggcaguccauaccgccuuggcuggagcccuagaagcagagauggauggugccaagggcaggcuguccucugggcaccucaaaugccggcugaagauggacaaacuucgccugaagggagugagcuauucauuguguacugcugccuucacguuuacaaaaauuccugcagaaacccuccauggcacugucaccguggagguucaguacgcggguacagacgggccaugcaaggugcccgcucaaauggccguagauaugcagacccugacuccugucggcagauuaauaacagcaaacccagugaucacggaaaguaccgagaacuccaagaugaugcuggagcuagaucccccguucggagacagcuacauuguuaucggcgugggggagaaaaagauaacucaccacuggcauaggucuggaucaacaauugguaaagccuuugaagcuaccguccguggcgccaagcggauggcagugcucggggacacagcuugggauuucggaaguguaggcggugcccugaauagccuugggaaaggcauccaccagaucuucggagcggccuuuaaguccuuguucggcgggaugucuugguuuucgcaaauucugaucggaacucuccugauguggcuuggccugaacaccaagaaugguagcauuuccuugaugugucucgcuuuagggggagugcugauauuccugucaacggcaguuagugccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8350 - RNA, 2317 nt, Artificial Sequence
  ZIKV prME variant mRNA Design 3 opt
gggagaaagcuuaccaugaaggagaaaaagagaaggggcgccgacaccagcguggggaucgucggacugcuccuuacaacugcuauggcagccgaaguuacgcggcgcgguuccgcguacuauauguaccuggaucgaaacgacgcuggcgaggccauuucuuuccccaccacauuggggaugaauaaaugcuauauacagaucauggauuuaggacacaugugugacgcaacuaugucauacgaaugcccuaugcuggaugagggcguggaaccagacgauguagacuguuggugcaacaccacaaguaccuggguggucuaugguacuugucaucacaagaaaggggaggcccguagaagcaggcgggcugugacacuaccgucccauucuacccgcaagcuccaaacgagaucgcagacuuggcuggagucaagggaauacaccaagcaccuuauucggguugagaauuggaucuuucgcaaccccggauucgcacuggccgcugccgcgauugcaugguugcucggcagcaguacaucccagaaagugaucuaucuggucaugauacugcucaucgccccugcuuacucuauucgaugcaucggcgugagcaauagagauuuuguagaagggauguccggagguacuuggguugacauuguguuagagcauggcgggugugucaccgugauggcccaggauaagccaacaguggacaucgagcuggucaccacgacuguuucaaacauggcagaagugaggaguuacugcuaugaggcuagcauaucugauauggccuccgacucacggugucccacacaaggagaagcguaccuugacaaacagagcgauacccaguauguaugcaagcguacuuugguggaccgcggcugggguaauggguguggacuguucggcaaaggcagucuagucacaugcgccaaguuugcaugcucuaagaaaaugaccgggaaguccauucagccugagaaccucgaauacagaaucaugcugagcgugcacggaucgcaacacucugguaugauuguuaaugauacgggccaugagaccgacgagaacagggcuaaaguggaaaucacaccaaauucaccccgggccgaggcuacucuugggggauucggcucccuggguuuggauugugaaccucgaaccgggcucgacuuuagugaucuguauuacuuaacaaugaacaauaagcacuggcugguccauaaagagugguuccacgacaucccacucccguggcacgccggcgcagauacuggaacaccccauuggaacaauaaggaagcccuuguggaguuuaaagacgcucacgcgaagcgccagaccguaguugugcugggcagccaggagggggcaguccauaccgccuuggcuggagcccuagaagcagagauggauggugccaagggcagacuguccucugggcaccucaaaugcaggcugaagauggacaaacuucggcugaagggagugagcuauucauuguguacugcugccuucacguuuacaaaaauuccugcagaaacccuccauggcacugucaccguggagguucaguacgcggguacagacgggccaugcaaggugcccgcucaaauggccguagauaugcagacccugacuccugucggccgcuuaauaacagcaaacccagugaucacggaaaguaccgagaacuccaagaugaugcuggagcuagaucccccguucggagacagcuacauuguuaucggcgugggggagaaaaagauaacucaccacuggcauagaucuggaucaacaauugguaaagccuuugaagcuaccgucaggggcgccaagcguauggcagugcucggggacacagcuugggauuucggaaguguaggcggugcccugaauagccuugggaaaggcauccaccagaucuucggagcggccuuuaaguccuuguucggcgggaugucuugguuuucgcaaauucugaucggaacucuccugauguggcuuggccugaacaccaagaaugguagcauuuccuugaugugucucgcuuuagggggagugcugauauuccugucaacggcaguuagugccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8351 - RNA, 2314 nt, Artificial Sequence
  ZIKV prME variant mRNA Design 3 opt
gggagaaagcuuaccauggagaagaaaagaaggggcgccgacaccagcguggggaucgucggacugcuccuuacaacugcuauggcagccgaaguuacgcggcgcgguuccgcguacuauauguaccuggaucgaaacgacgcuggcgaggccauuucuuuccccaccacauuggggaugaauaagugcuauauacagaucauggauuuaggacacaugugugacgcaacuaugucauacgaaugcccuaugcuggaugagggcguggaaccagacgauguagacuguuggugcaacaccacaaguaccuggguggucuaugguacuugucaucacaaaaagggggaggcccguagaagcaggcgggcugugacacuaccgucccauucuacccgcaaacuccaaacgagaucgcagacuuggcuggagucaagggaauacaccaagcaccuuauucggguugagaauuggaucuuucgcaaccccggauucgcacuggccgcugccgcgauugcaugguugcucggcagcaguacaucccagaaggugaucuaucuggucaugauacugcucaucgccccugcuuacucuauucgaugcaucggcgugagcaauagagauuuuguagaagggauguccggagguacuuggguugacauuguguuagagcauggcgggugugucaccgugauggcccaggauaaaccaacaguggacaucgagcuggucaccacgacuguuucaaacauggcagaagugaggaguuacugcuaugaggcuagcauaucugauauggccuccgacucacggugucccacacaaggagaagcguaccuugacaagcagagcgauacccaguauguaugcaaacguacuuugguggaccgcggcugggguaauggguguggacuguucggcaagggcagucuagucacaugcgccaaauuugcaugcucuaagaagaugaccgggaaauccauucagccugagaaccucgaauacagaaucaugcugagcgugcacggaucgcaacacucugguaugauuguuaaugauacgggccaugagaccgacgagaacagggcuaagguggaaaucacaccaaauucaccccgggccgaggcuacucuugggggauucggcucccuggguuuggauugugaaccucgaaccgggcucgacuuuagugaucuguauuacuuaacaaugaacaauaaacacuggcugguccauaaggagugguuccacgacaucccacucccguggcacgccggcgcagauacuggaacaccccauuggaacaauaaagaagcccuuguggaguuuaaggacgcucacgcgaaacgccagaccguaguugugcugggcagccaggagggggcaguccauaccgccuuggcuggagcccuagaagcagagauggauggugccaagggcagacuguccucugggcaccucaagugcaggcugaaaauggacaagcugcggcugaaaggagugagcuauucauuguguacugcugccuucacguuuacaaagauuccugcagaaacccuccauggcacugucaccguggagguucaguacgcggguacagacgggccaugcaaagugcccgcucaaauggccguagauaugcagacccugacuccugucggccgcuuaauaacagcaaacccagugaucacggaaaguaccgagaacuccaagaugaugcuggagcuagaucccccguucggagacagcuacauuguuaucggcgugggggaaaagaaaauaacucaccacuggcauagaucuggaucaacaauugguaaggccuuugaggcuaccgucaggggcgccaaacguauggcagugcucggggacacagcuugggauuucggaaguguaggcggugcccugaauagccuugggaagggcauccaccagaucuucggagcggccuuuaaauccuuguucggcgggaugucuugguuuucgcaaauucugaucggaacucuccugauguggcuuggccugaacaccaagaaugguagcauuuccuugaugugucucgcucuugggggaguguuaauauuccugucaacggcaguuagugccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8352 - RNA, 2311 nt, Artificial Sequence
  ZIKV prME variant mRNA Design 3 opt
gggagaaagcuuaccaugaagaaaagaaggggcgccgacaccagcguggggaucgucggacugcuccuuacaacugcuauggcagccgagguuacgcggcgcgguuccgcguacuauauguaccuggaucgaaacgacgcuggcgaagccauuucuuuccccaccacauuggggaugaauaagugcuauauacagaucauggauuuaggacacaugugugacgcaacuaugucauacgagugcccuaugcuggaugaaggcguggagccagacgauguagacuguuggugcaacaccacaaguaccuggguggucuaugguacuugucaucacaaaaagggggaagcccguagaagcaggcgggcugugacacuaccgucccauucuacccgcaaacuccaaacgagaucgcagacuuggcuggagucaagggaguacaccaagcaccuuauucggguugaaaauuggaucuuucgcaaccccggauucgcacuggccgcugccgcgauugcaugguugcucggcagcaguacaucccagaaggugaucuaucuggucaugauacugcucaucgccccugcuuacucuauucgaugcaucggcgugagcaauagagauuuuguagaggggauguccggagguacuuggguugacauuguguuagaacauggcgggugugucaccgugauggcccaggauaaaccaacaguggacaucgagcuggucaccacgacuguuucaaacauggcagaggugaggaguuacugcuaugaagcuagcauaucugauauggccuccgacucacggugucccacacaaggagaggcguaccuugacaagcagagcgauacccaguauguaugcaaacguacuuugguggaccgcggcugggguaauggguguggacuguucggcaagggcagucuagucacaugcgccaaauuugcaugcucuaagaagaugaccgggaaauccauucagccugaaaaccucgaguacagaaucaugcugagcgugcacggaucgcaacacucugguaugauuguuaaugauacgggccaugaaaccgacgagaacagggcuaagguggagaucacaccaaauucaccccgggccgaagcuacucuugggggauucggcucccuggguuuggauugugagccucgaaccgggcucgacuuuagugaucuguauuacuuaacaaugaacaauaaacacuggcugguccauaaggaaugguuccacgacaucccacucccguggcacgccggcgcagauacuggaacaccccauuggaacaauaaagaggcccuuguggaauuuaaggacgcucacgcgaaacgccagaccguaguugugcugggcagccaggagggggcaguccauaccgccuuggcuggagcccuagaggcagaaauggauggugccaagggcagacuguccucugggcaccucaagugcaggcugaaaauggacaagcugcggcugaaaggagugagcuauucauuguguacugcugccuucacguuuacaaagauuccugcagagacccuccauggcacugucaccguggaaguucaguacgcggguacagacgggccaugcaaagugcccgcucaaauggccguagauaugcagacccugacuccugucggccgcuuaauaacagcaaacccagugaucacggagaguaccgaaaacuccaagaugaugcuggagcuagaucccccguucggagacagcuacauuguuaucggcgugggggagaagaaaauaacucaccacuggcauagaucuggaucaacaauugguaaggccuuugaagcuaccgucaggggcgccaaacguauggcagugcucggggacacagcuugggauuucggaaguguaggcggugcccugaauagccuugggaagggcauccaccagaucuucggagcggccuuuaaauccuuguucggcgggaugucuugguuuucgcaaauucugaucggaacucuccugauguggcuuggccugaacaccaagaaugguagcauuuccuugaugugucucgcucuugggggaguguuaauauuccugucaacggcaguuagugccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8353 - RNA, 2308 nt, Artificial Sequence
  ZIKV prME variant mRNA Design 3 opt
gggagaaagcuuaccaugaagagaaggggcgccgacaccagcguggggaucgucggacugcuccuuacaacugcuauggcagccgagguuacgcggcgcgguuccgcguacuauauguaccuggaucgaaacgacgcuggcgaagccauuucuuuccccaccacauuggggaugaauaaaugcuauauacagaucauggauuuaggacacaugugugacgcaacuaugucauacgagugcccuaugcuggaugaaggcguggagccagacgauguagacuguuggugcaacaccacaaguaccuggguggucuaugguacuugucaucacaagaaaggggaagcccguagaagcaggcgggcugugacacuaccgucccauucuacccgcaagcuccaaacgagaucgcagacuuggcuggagucaagggaguacaccaaacaccuuauucggguugaaaauuggaucuuucgcaaccccggauucgcacuggccgcugccgcgauugcaugguugcucggcagcaguacaucccagaaggugaucuaucuggucaugauacugcucaucgccccugcuuacucuauucgaugcaucggcgugagcaauagagauuuuguagaggggauguccggagguacuuggguugacauuguguuagaacauggcgggugugucaccgugauggcccaggauaagccaacaguggacaucgagcuggucaccacgacuguuucaaacauggcagaggugaggaguuacugcuaugaagcuagcauaucugauauggccuccgacucacggugucccacacaaggagaggcguaccuugacaaacagagcgauacccaguauguaugcaagcguacuuugguggaccgcggcugggguaauggguguggacuguucggcaaaggcagucuagucacaugcgccaaguuugcaugcucuaaaaagaugaccgggaaguccauucagccugaaaaccucgaguacagaaucaugcugagcgugcacggaucgcaacacucugguaugauuguuaaugauacgggccaugaaaccgacgagaacagggcuaaaguggagaucacaccaaauucaccccgggccgaagcuacucuugggggauucggcucccuggguuuggauugugagccucgaaccgggcucgacuuuagugaucuguauuacuuaacaaugaacaauaagcacuggcugguccauaaagaaugguuccacgacaucccacucccguggcacgccggcgcagauacuggaacaccccauuggaacaauaaggaggcccuuguggaauuuaaagacgcucacgcgaagcgccagaccguaguugugcugggcagccaggagggggcaguccauaccgccuuggcuggagcccuagaggcagaaauggauggugccaaaggcagacuguccucugggcaccucaagugcaggcugaagauggacaaacuucggcugaagggagugagcuauucauuguguacugcugccuucacguuuacaaaaauuccugcagagacccuccauggcacugucaccguggaaguucaguacgcggguacagacgggccaugcaaggugcccgcucaaauggccguagauaugcagacccugacuccugucggccgcuuaauaacagcaaacccagugaucacggagaguaccgaaaacuccaaaaugaugcuggagcuagaucccccguucggagacagcuacauuguuaucggcgugggggagaagaagauaacucaccacuggcauagaucuggaucaacaauugguaaagccuuugaagcuaccgucaggggcgccaagcguauggcagugcucggggacacagcuugggauuucggaaguguaggcggugcccugaauagccuugggaaaggcauccaccagaucuucggagcggccuuuaaguccuuguucggcgggaugucuugguuuucgcaaauucugaucggaacucuccugauguggcuuggccugaacaccaaaaaugguagcauuuccuugaugugucucgcuuuagggggagugcugauauuccugucaacggcaguuagugccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8354 - RNA, 2305 nt, Artificial Sequence
  ZIKV prME variant mRNA Design 3 opt
gggagaaagcuuaccaugagaaggggcgccgacaccagcguggggaucgucggacugcuccuuacaacugcuauggcagccgagguuacgcggcgcgguuccgcguacuauauguaccuggaucgaaacgacgcuggcgaagccauuucuuuccccaccacauuggggaugaauaagugcuauauacagaucauggauuuaggacacaugugugacgcaacuaugucauacgagugcccuaugcuggaugaaggcguggagccagacgauguagacuguuggugcaacaccacaaguaccuggguggucuaugguacuugucaucacaaaaagggggaagcccguagaagcaggcgggcugugacacuaccgucccauucuacccgcaaacuccaaacgagaucgcagacuuggcuggagucaagggaguacaccaagcaccuuauucggguugaaaauuggaucuuucgcaaccccggauucgcacuggccgcugccgcgauugcaugguugcucggcagcaguacaucccagaaagugaucuaucuggucaugauacugcucaucgccccugcuuacucuauucgaugcaucggcgugagcaauagagauuuuguagaggggauguccggagguacuuggguugacauuguguuagaacauggcgggugugucaccgugauggcccaggauaagccaacaguggacaucgagcuggucaccacgacuguuucaaacauggcagaggugaggaguuacugcuaugaagcuagcauaucugauauggccuccgacucacggugucccacacaaggagaggcguaccuugacaagcagagcgauacccaguauguaugcaaacguacuuugguggaccgcggcugggguaauggguguggacuguucggcaagggcagucuagucacaugcgccaaauuugcaugcucuaagaaaaugaccgggaaguccauucagccugaaaaccucgaguacagaaucaugcugagcgugcacggaucgcaacacucugguaugauuguuaaugauacgggccaugaaaccgacgagaacagggcuaagguggagaucacaccaaauucaccccgggccgaagcuacucuugggggauucggcucccuggguuuggauugugagccucgaaccgggcucgacuuuagugaucuguauuacuuaacaaugaacaauaaacacuggcugguccauaaggaaugguuccacgacaucccacucccguggcacgccggcgcagauacuggaacaccccauuggaacaauaaagaggcccuuguggaauuuaaggacgcucacgcgaaacgccagaccguaguugugcugggcagccaggagggggcaguccauaccgccuuggcuggagcccuagaggcagaaauggauggugccaagggcagacuguccucugggcaccucaaaugcaggcugaagauggacaagcugcggcugaaaggagugagcuauucauuguguacugcugccuucacguuuacaaagauuccugcagagacccuccauggcacugucaccguggaaguucaguacgcggguacagacgggccaugcaaagugcccgcucaaauggccguagauaugcagacccugacuccugucggccgcuuaauaacagcaaacccagugaucacggagaguaccgaaaacuccaagaugaugcuggagcuagaucccccguucggagacagcuacauuguuaucggcgugggggagaaaaagauaacucaccacuggcauagaucuggaucaacaauugguaaggccuuugaagcuaccgucaggggcgccaaacguauggcagugcucggggacacagcuugggauuucggaaguguaggcggugcccugaauagccuugggaagggcauccaccagaucuucggagcggccuuuaaauccuuguucggcgggaugucuugguuuucgcaaauucugaucggaacucuccugauguggcuuggccugaacaccaagaaugguagcauuuccuugaugugucucgcucuugggggaguguuaauauuccugucaacggcaguuagugccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8355 - RNA, 2302 nt, Artificial Sequence
  ZIKV prME variant mRNA Design 3 opt
gggagaaagcuuaccaugagaggcgccgacaccagcguggggaucgucggacugcuccuuacaacugcuauggcagccgagguuacgaggcgggguuccgcguacuauauguaccuggaucgcaacgacgcuggcgaagccauuucuuuccccaccacauuggggaugaauaagugcuauauacagaucauggauuuaggacacaugugugacgcaacuaugucauacgagugcccuaugcuggaugaaggcguggagccagacgauguagacuguuggugcaacaccacaaguaccuggguggucuaugguacuugucaucacaaaaagggggaagcccgacguagcagaagggcugugacacuaccgucccauucuacccggaaacuccaaacgcgcucgcagacuuggcuggagucaagagaguacaccaagcaccuuauuaggguugaaaauuggaucuuucggaaccccggauucgcacuggccgcugccgcgauugcaugguugcucggcagcaguacaucccagaaagugaucuaucuggucaugauacugcucaucgccccugcuuacucuauucgcugcaucggcgugagcaaucgagauuuuguagaggggauguccggagguacuuggguugacauuguguuagaacauggcgggugugucaccgugauggcccaggauaagccaacaguggacaucgagcuggucaccacgacuguuucaaacauggcagaggugagaaguuacugcuaugaagcuagcauaucugauauggccuccgacucaaggugucccacacaaggagaggcguaccuugacaagcagagcgauacccaguauguaugcaaacggacuuugguggaccguggcugggguaauggguguggacuguucggcaagggcagucuagucacaugcgccaaauuugcaugcucuaagaaaaugaccgggaaguccauucagccugaaaaccucgaguaccgcaucaugcugagcgugcacggaucgcaacacucugguaugauuguuaaugauacgggccaugaaaccgacgagaacagagcuaagguggagaucacaccaaauucccccagggccgaagcuacucuugggggauucggcucacuggguuuggauugugagccucggaccgggcucgacuuuagugaucuguauuacuuaacaaugaacaauaaacacuggcugguccauaaggaaugguuccacgacaucccacucccguggcacgccggcgcagauacuggaacaccccauuggaacaauaaagaggcccuuguggaauuuaaggacgcucacgcgaaacgacagaccguaguugugcugggcagccaggagggggcaguccauaccgccuuggcuggagcccuagaggcagaaauggauggugccaagggccgccuguccucugggcaccucaaaugcagacugaagauggacaagcugaggcugaaaggagugagcuauucauuguguacugcugccuucacguuuacaaagauuccugcagagacccuccauggcacugucaccguggaaguucaguacgcggguacagacgggccaugcaaagugcccgcucaaauggccguagauaugcagacccugacuccugucggccgguuaauaacagcaaacccagugaucacggagaguaccgaaaacuccaagaugaugcuggagcuagaucccccguucggagacagcuacauuguuaucggcgugggggagaaaaagauaacucaccacuggcaucgcucuggaucaacaauugguaaggccuuugaagcuaccgucagaggcgccaaaaggauggcagugcucggggacacagcuugggauuucggaaguguaggcggugcccugaauagccuugggaagggcauccaccagaucuucggagcggccuuuaaauccuuguucggcgggaugucuugguuuucgcaaauucugaucggaacucuccugauguggcuuggccugaacaccaagaaugguagcauuuccuugaugugucucgcucuugggggaguguuaauauuccugucaacggcaguuagugccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8356 - RNA, 2299 nt, Artificial Sequence
  ZIKV prME variant mRNA Design 3 opt
gggagaaagcuuaccaugggcgccgacaccagcguggggaucgucggacugcuccuuacaacugcuauggcagccgagguuacgagaagggguuccgcguacuauauguaccuggaucggaacgacgcuggcgaagccauuucuuuccccaccacauuggggaugaauaagugcuauauacagaucauggauuuaggacacaugugugacgcaacuaugucauacgagugcccuaugcuggaugaaggcguggagccagacgauguagacuguuggugcaacaccacaaguaccuggguggucuaugguacuugucaucacaaaaagggggaagcccgccgaagccguagagcugugacacuaccgucccauucuaccaggaaacuccaaacgcggucgcagacuuggcuggagucacgcgaguacaccaagcaccuuauuagaguugaaaauuggaucuuuaggaaccccggauucgcacuggccgcugccgcgauugcaugguugcucggcagcaguacaucccagaaagugaucuaucuggucaugauacugcucaucgccccugcuuacucuauucggugcaucggcgugagcaaucgcgauuuuguagaggggauguccggagguacuuggguugacauuguguuagaacauggcgggugugucaccgugauggcccaggauaagccaacaguggacaucgagcuggucaccacgacuguuucaaacauggcagaggugcgaaguuacugcuaugaagcuagcauaucugauauggccuccgacucaagaugucccacacaaggagaggcguaccuugacaagcagagcgauacccaguauguaugcaaaaggacuuugguggaccggggcugggguaauggguguggacuguucggcaagggcagucuagucacaugcgccaaauuugcaugcucuaagaaaaugaccgggaaguccauucagccugaaaaccucgaguaccguaucaugcugagcgugcacggaucgcaacacucugguaugauuguuaaugauacgggccaugaaaccgacgagaaccgcgcuaagguggagaucacaccaaauucccccagagccgaagcuacucuugggggauucggcucacuggguuuggauugugagccuaggaccgggcucgacuuuagugaucuguauuacuuaacaaugaacaauaaacacuggcugguccauaaggaaugguuccacgacaucccacucccguggcacgccggcgcagauacuggaacaccccauuggaacaauaaagaggcccuuguggaauuuaaggacgcucacgcgaaacggcagaccguaguugugcugggcagccaggagggggcaguccauaccgccuuggcuggagcccuagaggcagaaauggauggugccaagggccgacuguccucugggcaccucaaaugccgccugaagauggacaagcugagacugaaaggagugagcuauucauuguguacugcugccuucacguuuacaaagauuccugcagagacccuccauggcacugucaccguggaaguucaguacgcggguacagacgggccaugcaaagugcccgcucaaauggccguagauaugcagacccugacuccugucggcagguuaauaacagcaaacccagugaucacggagaguaccgaaaacuccaagaugaugcuggagcuagaucccccguucggagacagcuacauuguuaucggcgugggggagaaaaagauaacucaccacuggcaucggucuggaucaacaauugguaaggccuuugaagcuaccguccgcggcgccaaaagaauggcagugcucggggacacagcuugggauuucggaaguguaggcggugcccugaauagccuugggaagggcauccaccagaucuucggagcggccuuuaaauccuuguucggcgggaugucuugguuuucgcaaauucugaucggaacucuccugauguggcuuggccugaacaccaagaaugguagcauuuccuugaugugucucgcucuugggggaguguuaauauuccugucaacggcaguuagugccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8357 - RNA, 2296 nt, Artificial Sequence
  ZIKV prME variant mRNA Design 3 opt
gggagaaagcuuaccauggccgacaccagcgugggcaucgucgggcugcuccuuacaacugcuauggcagccgagguuacgagaaggggauccgcguacuauauguaccuggaucggaacgacgcuggugaagccauuucuuuccccaccacauugggcaugaauaagugcuauauacagaucauggauuuagggcacaugugugacgcaacuaugucauacgagugcccuaugcuggaugaaggaguggagccagacgauguagacuguuggugcaacaccacaaguaccuggguggucuauggcacuugucaucacaaaaagggugaagcccgccgaagccguagagcugugacacuaccgucccauucuaccaggaaacuccaaacgcggucgcagacuuggcuggagucacgcgaguacaccaagcaccuuauuagaguugaaaauuggaucuuuaggaaccccggguucgcacuggccgcugccgcgauugcaugguugcucggaagcaguacaucccagaaagugaucuaucuggucaugauacugcucaucgccccugcuuacucuauucggugcaucggcgugagcaaucgcgauuuuguagagggcauguccgggggaacuuggguugacauuguguuagaacaugguggcugugucaccgugauggcccaggauaagccaacaguggacaucgagcuggucaccacgacuguuucaaacauggcagaggugcgaaguuacugcuaugaagcuagcauaucugauauggccuccgacucaagaugucccacacaaggggaggcguaccuugacaagcagagcgauacccaguauguaugcaaaaggacuuugguggaccggggauggggcaaugguugugggcuguucggaaagggcagucuagucacaugcgccaaauuugcaugcucuaagaaaaugaccggcaaguccauucagccugaaaaccucgaguaccguaucaugcugagcgugcacgggucgcaacacucuggaaugauuguuaaugauacgggucaugaaaccgacgagaaccgcgcuaagguggagaucacaccaaauucccccagagccgaagcuacucuuggcggguucggaucacugggcuuggauugugagccuaggaccggucucgacuuuagugaucuguauuacuuaacaaugaacaauaaacacuggcugguccauaaggaaugguuccacgacaucccacucccguggcacgccggggcagauacuggcacaccccauuggaacaauaaagaggcccuuguggaauuuaaggacgcucacgcgaaacggcagaccguaguugugcugggaagccaggagggcgcaguccauaccgccuuggcuggggcccuagaggcagaaauggauggagccaagggucgacuguccucuggccaccucaaaugccgccugaagauggacaaacuuagacugaagggggugagcuauucauuguguacugcugccuucacguuuacaaagauuccugcagagacccuccauggaacugucaccguggaaguucaguacgcgggcacagacgguccaugcaaagugcccgcucaaauggccguagauaugcagacccugacuccugucgggagguuaauaacagcaaacccagugaucacggagaguaccgaaaacuccaagaugaugcuggagcuagaucccccguucggcgacagcuacauuguuaucggagugggcgagaaaaagauaacucaccacuggcaucggucugggucaacaauuggaaaggccuuugaagcuaccguccgcggugccaaaagaauggcagugcucggcgacacagcuugggauuucgggaguguaggaggcgcccugaauagccuugguaaggggauccaccagaucuucggcgcggccuuuaaauccuuguucggaggcaugucuugguuuucgcaaauucugaucgggacucuccugauguggcuuggacugaacaccaagaauggcagcauuuccuugaugugucucgcucugggugggguguuaauauuccugucaacggcaguuagugccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8358 - RNA, 2293 nt, Artificial Sequence
  ZIKV prME variant mRNA Design 3 opt
gggagaaagcuuaccauggacaccagcgugggcaucgucgggcugcuccuuacaacugccauggcugcagagguuacgagaaggggauccgccuacuauauguaccuggaucggaacgacgcgggugaagcuauuucuuuccccaccacauugggcaugaauaagugcuauauacagaucauggauuuagggcacaugugugacgccacuaugucauacgagugcccuaugcuggaugaaggaguggagccagacgauguagacuguuggugcaacaccacaaguaccuggguggucuauggcacuugucaucacaaaaagggugaagcacgccgaagccguagagccgugacacuaccgucccauucuaccaggaaacuccaaacgcggucgcagacuuggcuggagucacgcgaguacaccaagcaccuuauuagaguugaaaauuggaucuuuaggaaccccggguucgcucuggcagccgcugccauugcgugguugcucggaagcaguacaucccagaaagugaucuaucuggucaugauacugcucaucgcacccgccuacucuauucggugcaucggcgugagcaaucgcgauuuuguagagggcauguccgggggaacuuggguugacauuguguuagaacaugguggcugugucaccgugauggcucaggauaagccaacaguggacaucgagcuggucaccacgacuguuucaaacauggccgaggugcgaaguuacugcuaugaagcaagcauaucugauauggcuuccgacucaagaugucccacacaaggggaggccuaccuugacaagcagagcgauacccaguauguaugcaaaaggacuuugguggaccggggauggggcaaugguugugggcuguucggaaagggcagucuagucacaugcgcgaaauuugccugcucuaagaaaaugaccggcaaguccauucagccugaaaaccucgaguaccguaucaugcugagcgugcacgggucgcaacacucuggaaugauuguuaaugauacgggucaugaaaccgacgagaaccgcgcaaagguggagaucacaccaaauucccccagagcugaagccacucuuggcggguucggaucacugggcuuggauugugagccuaggaccggucucgacuuuagugaucuguauuacuuaacaaugaacaauaaacacuggcugguccauaaggaaugguuccacgacaucccacucccguggcacgcuggggccgauacuggcaccccucauuggaacaauaaagaggcacuuguggaauuuaaggacgcccacgcuaaacggcagacaguaguugugcugggaagccaggagggcgcgguccauaccgcauuggccggggcucuagaggccgaaauggauggagcaaagggucgacuguccucuggccaccucaaaugccgccugaagauggacaaacuuagacugaagggggugagcuauucauuguguacugccgcuuucacguuuacaaagauuccugccgagacccuccauggaacugucaccguggaaguucaguacgcaggcacagacgguccaugcaaagugcccgcgcaaauggcuguagauaugcagacccugacuccugucgggagguuaauaacagccaacccagugaucacggagaguaccgaaaacuccaagaugaugcuggagcuagaucccccguucggcgacagcuacauuguuaucggagugggcgagaaaaagauaacucaccacuggcaucggucugggucaacaauuggaaaggcauuugaagccaccguccgcggugcuaaaagaauggccgugcucggcgacacagcaugggauuucgggaguguaggaggcgcucugaauagccuugguaaggggauccaccagaucuucggcgccgcguuuaaauccuuguucggaggcaugucuugguuuucgcaaauucugaucgggacucuccugauguggcuuggacugaacaccaagaauggcagcauuuccuugaugugucucgcccugggugggguguuaauauuccugucaacggcuguuagugcaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8359 - RNA, 2290 nt, Artificial Sequence; identical to SEQ ID NO: 8265
  ZIKV (strain ZikaSPH2015) Polyprotein(108-794) mRNA Design 3 opt

SEQ ID NO: 8360 - RNA, 2290 nt, Artificial Sequence
  ZIKV prME variant mRNA Design 3 opt
gggagaaagcuuaccaugaccagcgugggcaucgucgggcugcuccuuacaacugccauggcugcagccguuacgagaaggggauccgcguacuauauguaccuggaccggaacgaugcuggugaggccauuucuuuccccaccacauugggcaugaauaagugcuauauacagaucauggacuuagggcacaugugugaugcaacuaugucauacgaaugcccuaugcuggacgagggaguggaaccagaugacguagauuguuggugcaacaccacaaguaccuggguggucuauggcacuugucaucacaaaaagggugaggcccgccgaagccguagagcugugacacuaccgucccauucuaccaggaaacuccaaacgcggucgcagacuuggcuggaaucacgcgaguacaccaagcaccuuauuagaguugagaauuggaucuuuaggaaccccggguucgcacuggccgcugccgcgauugcaugguugcucggaagcaguacaucccagaaagugaucuaucuggucaugauacugcucaucgccccugcuuacucuauucggugcaucggcgugagcaaucgcgacuuuguagaaggcauguccgggggaacuuggguugauauuguguuagagcaugguggcugugucaccgugauggcccaggacaagccaacaguggauaucgaacuggucaccacgacuguuucaaacauggcagaggugcgaaguuacugcuaugaggcuagcauaucugacauggccuccgauucaagaugucccacacaaggggaagcguaccuugacaagcagagcgacacccaguauguaugcaaaaggacuuugguggaucggggauggggcaaugguugugggcuguucggaaagggcagucuagucacaugcgccaaauuugcaugcucuaagaaaaugaccggcaaguccauucagccugagaaccucgaauaccguaucaugcugagcgugcacgggucgcaacacucuggaaugauuguuaaugacacgggucaugagaccgaugaaaaccgcgcuaagguggagaucacaccaaauucccccagagccgaggcuacucuuggcggguucggaucacugggcuuggacugugaaccuaggaccggucucgauuuuagugaccuguauuacuuaacaaugaacaauaaacacuggcugguccauaaggagugguuccacgauaucccacucccguggcacgccggggcagacacuggcacaccccauuggaacaauaaagaagcccuuguggaguuuaaggaugcucacgcgaaacggcagaccguaguugugcugggaagccaggaaggcgcaguccauaccgccuuggcuggggcccuagaggcagagauggacggagccaagggucgacuguccucuggccaccucaaaugccgccugaagauggauaaacuuagacugaagggggugagcuauucauuguguacugcugccuucacguuuacaaagauuccugcagaaacccuccauggaacugucaccguggagguucaguacgcgggcacagacgguccaugcaaagugcccgcucaaauggccguagacaugcagacccugacuccugucgggagguuaauaacagcaaacccagugaucacggaaaguaccgagaacuccaagaugaugcuggaacuagaucccccguucggcgacagcuacauuguuaucggagugggcgagaaaaagauaacucaccacuggcaucggucugggucaacaauuggaaaggccuuugaggcuaccguccgcggugccaaaagaauggcagugcucggcgauacagcuugggacuucgggaguguaggaggcgcccugaauagccuugguaaggggauccaccagaucuucggcgcggccuuuaaauccuuguucggaggcaugucuugguuuucgcaaauucugaucgggacucuccugauguggcuuggacugaacaccaagaauggcagcauuuccuugaugugucucgcucugggugggguguuaauauuccugucaacggcaguuagugccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8361 - RNA, 2302 nt, Artificial Sequence
  ZIKV prME variant mRNA Design 3 opt
gggagaaagcuuaccaugagaggcgccgacaccagcguggggaucgucggacugcuccuuacaacugcuauggcagccgcgguuacgaggcgggguuccgcuuacuauauguaccuggaucgcaacgacgccggcgaggcaauuucuuuccccaccacauuggggaugaauaagugcuauauacagaucauggauuuaggacacaugugugacgccacuaugucauacgaaugcccuaugcuggaugagggcguggaaccagacgauguagacuguuggugcaacaccacaaguaccuggguggucuaugguacuugucaucacaaaaagggggaggcucgacguagcagaagggcagugacacuaccgucccauucuacccggaaacuccaaacgcgcucgcagacuuggcuggaaucaagagaguacaccaagcaccuuauuaggguugagaauuggaucuuucggaaccccggauucgcccuggcugccgcggcaauugccugguugcucggcagcaguacaucccagaaagugaucuaucuggucaugauacugcucaucgcuccugccuacucuauucgcugcaucggcgugagcaaucgagauuuuguagaagggauguccggagguacuuggguugacauuguguuagagcauggcgggugugucaccgugauggcacaggauaagccaacaguggacaucgaacuggucaccacgacuguuucaaacauggcugaggugagaaguuacugcuaugaggccagcauaucugauauggcguccgacucaaggugucccacacaaggagaagccuaccuugacaagcagagcgauacccaguauguaugcaaacggacuuugguggaccguggcugggguaauggguguggacuguucggcaagggcagucuagucacaugcgcaaaauuugcuugcucuaagaaaaugaccgggaaguccauucagccugagaaccucgaauaccgcaucaugcugagcgugcacggaucgcaacacucugguaugauuguuaaugauacgggccaugagaccgacgaaaacagagccaagguggagaucacaccaaauucccccagggcugaggccacucuugggggauucggcucacuggguuuggauugugaaccucggaccgggcucgacuuuagugaucuguauuacuuaacaaugaacaauaaacacuggcugguccauaaggagugguuccacgacaucccacucccguggcacgcaggcgccgauacuggaacaccccauuggaacaauaaagaagcucuuguggaguuuaaggacgcgcacgcaaaacgacagaccguaguugugcugggcagccaggaaggggccguccauaccgcuuuggccggagcacuagaggccgagauggauggugcuaagggccgccuguccucugggcaccucaaaugcagacugaagauggacaagcugaggcugaaaggagugagcuauucauuguguacugccgcauucacguuuacaaagauuccugcggaaacccuccauggcacugucaccguggagguucaguacgcugguacagacgggccaugcaaagugcccgcccaaauggcaguagauaugcagacccugacuccugucggccgguuaauaacagccaacccagugaucacggaaaguaccgagaacuccaagaugaugcuggaacuagaucccccguucggagacagcuacauuguuaucggcgugggggagaaaaagauaacucaccacuggcaucgcucuggaucaacaauugguaaggcuuuugaggccaccgucagaggcgcaaaaaggauggcugugcucggggacacagccugggauuucggaaguguaggcggugcgcugaauagccuugggaagggcauccaccagaucuucggagccgcuuuuaaauccuuguucggcgggaugucuugguuuucgcaaauucugaucggaacucuccugauguggcuuggccugaacaccaagaaugguagcauuuccuugaugugucucgcacuugggggaguguuaauauuccugucaacggccguuagugcuugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8362 - RNA, 2326 nt, Artificial Sequence
  ZIKV prME variant mRNA Design 3 opt
gggagaaagcuuaccaugagaggccugagcuccaggaagcggcgcucucacgacgugcucaccguccaguuccuuauccuggggauguuguuaaugacaggagguguuacucgacguggcucagccuacuauauguaccuggauagaaacgacgcuggggaggcaauuaguuuucccacgacccuaggaaugaauaaaugcuauauacaaaucauggaucucggccauaugugugacgccacaaugagcuacgaaugcccuaugcuggaugaggguguggaaccagacgauguagacuguuggugcaacacuaccuccacauggguggucuaugggaccugucaccauaagaaaggagaggcgaggcggucucgcagagcugugacucuuccgucgcacucaacaaggaagcugcagacccggagccagacgugguuggaaagucgcgaguacacuaaacaucucauucgaguugagaauuggaucuucagaaaccccggcuuugcccuggcagccgcugcaauugccuggcugcucggcuccucuaccagccagaaggugaucuauuuagucaugauacugcuuaucgcuccugccuacuccauuaggugcaucggggugucaaaucgggauuucguagaaggaaugagugguggcacauggguugacauuguguuggagcacgggggaugugucacugugauggcgcaagauaagccaaccguggacaucgaacuggucacaaccacgguuagcaacauggcagaggugcguucuuacugcuaugaggccuccauaucagauauggcuagcgacagucgcugucccacucagggcgaagccuaccuagacaaacagucugauacacaguauguaugcaagagaacccucguggacagggguugggggaauggauguggccuguuuggcaaagggucccuugucacuugcgcaaaguucgcuugcagcaaaaagaugacaggaaagucgauucaaccugagaaccuggaauaccggaucauguugucugugcacgguucccagcauucaggcaugauuguuaaugauaccgggcacgagacggacgaaaaccgagccaaaguggagaucaccccaaauaguccccgcgcggaggccacacucggaggcuuugguagccugggguuagauugugaaccuagaacuggccuggacuucuccgaucucuauuaccuuaccaugaacaauaagcauuggcugguccacaaagagugguuucacgacaucccauugccguggcaugcaggagcugauacaggcacuccccacuggaacaauaaggaagcccuaguggaguucaaagacgcucaugccaagaggcagaccguaguugugcuggggucucaggaaggagcaguccacacagcccucgcuggugcgcuggaggcagagauggauggcgccaaagggcggcuuagcucaggacaucugaagugccgcuugaagauggacaaacucagacugaagggcgugaguuauuccuuauguaccgcugccuuuacuuucacgaaaauuccugcagaaacacugcacgguaccgucacuguggagguucaauacgccgggaccgacggcccaugcaaggugcccgcucagauggccguagauaugcagacacuaaccccugucggaaggcucauaacugcaaacccagugaucacagaaagcacggagaacucuaaaaugaugcuggaacuugaucccccguuuggcgacucauacauuguuaucggggugggagagaagaagauaacccaccauuggcaccguagugguagcacuauuggcaaagcguucgaggcuacaguccgaggggccaagcggauggcaguguugggagacaccgccugggauuucggcuccguagguggggcucucaauucucugggcaaaggaauccaucaaaucuuuggcgccgcauucaagucgcuguuugggggaaugagcugguucucccagauucuuaucggcacacuguugauguggcucggucugaacacuaaaaaugggucaauuaguuuaaugugucuggcucuaggaggcgugcucauauuucugucuaccgccguuagcgcgugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8363 - RNA, 2326 nt, Artificial Sequence
  ZIKV prME variant mRNA Design 3 opt
gggagaaagcuuaccaugagaggccugagcuccaggaagcggcgcucucacgacgugcucaccguccaguuccuuauccuggggauguuguuaaugacaggagccguuacucgacgugguucagcuuacuauauguaccuggauagaaacgacgcaggcgaggccauuaguuuucccacgacccuagggaugaauaaaugcuauauacaaaucauggaucucggacauaugugugacgcgacaaugagcuacgaaugcccuaugcuggaugagggcguggaaccagacgauguagacuguuggugcaacacuaccuccacauggguggucuaugguaccugucaccauaagaaaggggaggcuaggcggucucgcagagccgugacucuuccgucgcacucaacaaggaagcugcagacccggagccagacgugguuggaaagucgcgaguacacuaaacaucucauucgaguugagaauuggaucuucagaaaccccggauuugcacuggccgcugcagccauugcuuggcugcucggcuccucuaccagccagaaggugaucuauuuagucaugauacugcuuaucgccccugcguacuccauuaggugcaucggcgugucaaaucgggauuucguagaagggaugaguggagguacauggguugacauuguguuggagcacggcgggugugucacugugauggcacaagauaagccaaccguggacaucgaacuggucacaaccacgguuagcaacauggccgaggugcguucuuacugcuaugaggcuuccauaucagauauggccagcgacagucgcugucccacucagggagaagcauaccuagacaaacagucugauacacaguauguaugcaagagaacccucguggacaggggcugggguaauggguguggacuguuuggcaaaggcucccuugucacuugcgcuaaguucgccugcagcaaaaagaugacagggaagucgauucaaccugagaaccuggaauaccggaucauguugucugugcacggaucccagcauucagguaugauuguuaaugauaccggccacgagacggacgaaaaccgagcgaaaguggagaucaccccaaauaguccccgcgccgaggcaacacucgggggauuuggcagccuggguuuagauugugaaccuagaacugggcuggacuucuccgaucucuauuaccuuaccaugaacaauaagcauuggcugguccacaaagagugguuucacgacaucccauugccguggcaugcuggcgccgauacaggaacuccccacuggaacaauaaggaagcucuaguggaguucaaagacgcccaugcaaagaggcagaccguaguugugcugggcucucaggaaggggccguccacacagcucucgcgggagcacuggaggccgagauggauggugcuaaaggccggcuuagcucagggcaucugaagugccgcuugaagauggacaaacucagacugaagggagugaguuauuccuuauguaccgccgcauuuacuuucacgaaaauuccugccgaaacacugcacggcaccgucacuguggagguucaauacgcugguaccgacgggccaugcaaggugcccgcccagauggcaguagauaugcagacacuaaccccugucggcaggcucauaacugcgaacccagugaucacagaaagcacggagaacucuaaaaugaugcuggaacuugaucccccguuuggagacucauacauuguuaucggcgugggggagaagaagauaacccaccauuggcaccguaguggaagcacuauugguaaggcuuucgaggccacaguccggggcgcaaaacgaauggccguguugggggacaccgcuugggauuucggauccguaggcggugcccucaauucucuggggaaaggcauccaucaaaucuuuggagcagcuuucaagucgcuguuuggcgggaugagcugguucucccagauucuuaucggaacacuguugauguggcucggccugaacacuaaaaaugguucaauuaguuuaaugugucuggcccuagggggagugcucauauuucugucuaccgcgguuagcgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8364 - RNA, 2365 nt, Artificial Sequence; identical to SEQ ID NO: 8261
  KU321639.1 prME-long mRNA Design 3 opt

SEQ ID NO: 8365 - RNA, 2365 nt, Artificial Sequence; identical to SEQ ID NO: 8262
  KU312312.1 prME-long mRNA Design 3 opt

SEQ ID NO: 8366 - RNA, 2353 nt, Artificial Sequence; identical to SEQ ID NO: 8263
  AY632535.2 prME-long mRNA Design 3 opt

SEQ ID NO: 8367 - RNA, 2365 nt, Artificial Sequence; identical to SEQ ID NO: 8264
  KU527068.1 prME-long mRNA Design 3 opt

SEQ ID NO: 8368 - RNA, 2365 nt, Artificial Sequence
  KU720415.1 prME-long mRNA Design 3 opt
gggagaaagcuuaccaugagaaucauuaacgccaggaaggagcggaaacgccgaggcgcugacaccagcauagggaucauuggacugcuccuuacaacugcaauggccgcggaaaucacgcguagagguuccgcuuacuauauguaccuggauaggucugacgccggcaaggcaauuucauucgccaccacauugggggugaauaaaugccacguccagaucauggauuuaggacauaugugugacgcuacuaugaguuaugagugccccaugcuggaugaaggcguugagccugacgauguggacuguuggugcaacaccacaagcaccuggguaguguacgguacuugucaccauaagaaaggggaagcacggcgcuccagaagggccgucacacuaccaucucacucgacccggaagcuccaaacgcgcucacagacuuggcuggagagccgagaguauaccaagcaucuuauaaaaguggaaaauuggaucuuuagaaacccgggauucgcucugguugccguggcgauugcaugguugcucggcaguuccacaucucagaaggucaucuaccuggugaugauucugcucaucgcccccgcuuauagcauaaggugcauuggcguauccaaucgggauuuuguugaggggaugucaggagguacuuggguggacgucguguuagaacacggcgggugugugaccgucauggcccaggauaaaccuacaguugacaucgagcuggugaccacgacuguaaguaacauggcagaggugcguagcuacugcuacgaggcuucuauuuccgauauggccucagacagccgcuguccaacacaaggagaagcguaucuugacaagcagagugauacccaguacgucugcaaaagaacuuugguggacaggggcugggguaauggguguggacuguucggcaagggcucucuaguuacaugcgccaaguuuaccugcuccaaaaagaugacggggaaaagcauccagcccgaaaaccucgaguaucggaucaugcugucggugcacggaucucaacauuccgguaugauugucaaugauaccggcuacgaaacagacgagaaccgagcaaagguggagguaacuccuaauucaccacgcgcugaagccacccuugggggauucggcagucuggguuuggauugugagcccagaacagggcucgacuuuagcgaucuguauuacuuaacuaugaacaauaaacacuggcugguucauaaggaaugguuccacgacauaccucucccauggcacgcuggcgccgauaccggaacaccgcauuggaacaauaaagaggcacuuguggaauuuaaggacgcccacgcuaagaggcagaccgucgugguccugggcucccaggagggggcggugcauacugcauuggccggagcucuagaggccgaaauggauggugcaaaaggcaagcuguucucugggcaccucaaaugccggcugaagauggacaaacuucgccugaagggaguuagcuauucauuguguacggccgcuuuuacauucaccaaggugcccgccgagacucuccauggcaccguaacagucgaagugcaguacgcagguaccgacgggccuugcaaaaucccaguucaaauggcgguggauaugcagacucugacacccgucggcagauuaauuacggcuaacccugugaucaccgagaguacugaaaacuccaagaugaugcuggagcuagacccacccuuuggagauagcuacauaguaauuggcgugggggacaaaaagaucacacaccacuggcauaggucuggaucaaccaucgguaaagccuucgaggcaacaguucguggcgccaagcggauggcuguccucggggauacugccugggacuucggaagugugggcgguguguuuaauagccuggggaagggcauucaccagaucuucggagcagcuuuuaaaucccuuuucggcgggaugucuugguuuucgcaaauuuugauaggaacccugcucgucuggcugggccuuaacacgaagaaugguagcaucucccugaccuguuuggcccucgggggaguuaugauuuuccugucaacagcggugagugccgaugugggcugcucuguagacuuuagcaaaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8369 - RNA, 2347 nt, Artificial Sequence
  DQ859059.1 prME-long mRNA Design 3 opt
gggagaaagcuuaccaugagaaucauuaacgccaggaaggagcggaaacgccgaggcgcugacaccagcauagggaucgugggacugcuccuuacaacugcaauggccgcggaaauuacgcguagagguuccgcuuacuauauguaccuggauaggucugacgccggcaaggcaaucucauucgccaccacauugggggucaauaaaugccacguucagauuauggauuuaggacauaugugugacgcuacuaugaguuaugagugccccaugcuggaugaaggcguggagccugacgauguagacuguuggugcaacaccacaagcaccuggguggucuacgguacuugucaccauaagaaaggggaagcacggcgcuccagaagggccgugacacuaccaucucacucgacccggaagcuccaaacgcgcucacagacuuggcuggagagccgagaguauaccaagcaucuuaucaaaguugaaaauuggauauuuagaaacccgggauucacacugguggcugucgccaucgcgugguugcucggcaguuccacuucucagaaggugauuuaccugguaaugauccugcucauugcacccgccuauagcaucaggugcauaggcguuuccaaucgggauuuuguggaggggaugucaggagguaccugggucgacgugguguuagaacacggcgggugugucacaguuauggcucaggauaaaccuaccguggacauugagcugguaacgacuacagugaguaacauggccgagguccguagcuacugcuacgaagcaucuaucuccgauauggcuucagacagccgcuguccaacccaaggagaggccuaucuugacaagcagagugauacucaguacgugugcaaaagaacauugguugacaggggcugggguaauggguguggacuguucggcaagggcucucuagugaccugcgcgaaguuuacgugcuccaaaaagaugaccgggaaaagcauucagcccgaaaaccucgaguaucggaucaugcugucgguccacggaucucaacauuccgguaugaucgugaaugaugaaaaccgagccaagguagagguuacaccuaauucaccacgcgcagaggcuacucuuggcggguucggaagucugggcuuggacugugaacccagaaccggucucgauuuuagcgaccuguacuauuuaacaaugaacaauaaacacuggcuggugcauaaggagugguuccacgauauuccucucccauggcacgccggggcugacacuggcaccccgcauuggaacaauaaagaagcccuugucgaguuuaaggaugcacacgccaagaggcagacaguggucgugcugggaucccaggaaggcgcuguucauaccgcguuggcaggggcccuagaggcugagauggacggagccaaaggucggcuguucucuggccaccucaagugccgccugaaaauggauaaacuuagacugaagggggugagcuacucauuguguacugcagccuuuacguucacaaagguacccgcugaaacccuccauggaacugucaccguggagguucaguaugccggcacagacgguccuugcaaggugccagcacaaauggcggucgacaugcagacccugacucccguggggagguuaauaacagcuaacccuguaaucacggaaaguaccgagaacuccaaaaugaugcuggaacuagauccacccuuuggcgacagcuacauugugaucggaguuggcgauaagaaaauaacucaccacuggcaucguucugggucaacaauuggaaaggccuucgaggcaaccguccggggugccaaacgaauggcugugcucggcgacacagccugggauuucgggagugugggaggcgucuuuaauagccuggguaaggggauccaccagaucuucggcgcagcuuuuaagucccuuuucggaggcaugucuugguuuucgcaaauuuugaucgggacucugcucguuuggcugggacuuaacaccaaaaauggcagcauuucccugacguguuuggcccucgguggggugaugauauuccugucaaccgcggugagugccgacguaggaugcucugucgauuuuagcaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8370 - RNA, 2365 nt, Artificial Sequence
  KX377335.1 prME-long mRNA Design 3 opt
gggagaaagcuuaccaugagaaucauuaacgccaggaaggagcggaaacgccgaggcgcugacaccagcauagggaucauuggacugcuccuuacaacugcaauggccgcggaaaucacgcguagagguuccgcuuacuauauguaccuggauaggucugacgccggcaaggcaauuucauucgccaccacauugggggugaauaaaugccacguccagaucauggauuuaggacauaugugugacgcuacuaugaguuaugagugccccaugcuggaugaaggcguugagccugacgauguggacuguuggugcaacaccacaagcaccuggguaguguacgguacuugucaccggaagaaaggggaagcacgcagauccaggcgggccgucacacuaccaucucauucgacccgcaagcuccaaacgcgaucacagacuuggcuggagagcagagaguauaccaagcaccuuauaaaaguggaaaauuggaucuuuaggaacccgggauucgcucugguugccguggcgauugcaugguugcucggcaguuccacaucucagaaggucaucuaccuggugaugauucugcucaucgcccccgcuuauagcauacggugcauuggcguauccaaucgugauuuuguugaggggaugucaggagguacuuggguggacgucguguuagaacauggcgggugugugaccgucauggcccaggauaaaccuacaguugacaucgagcuggugaccacgacuguaaguaacauggcagaggugcgcagcuacugcuacgaggcuucuauuuccgauauggccucagacagcagauguccaacacaaggagaagcguaucuugacaagcagagugauacccaguacgucugcaaaaggacuuugguggaccggggcugggguaauggguguggacuguucggcaagggcucucuaguuacaugcgccaaguuuaccugcuccaaaaagaugacggggaaaagcauccagcccgaaaaccucgaguaucgaaucaugcugucggugcacggaucucaacacuccgguaugauugucaaugauaccggcuacgaaacagacgagaaccgcgcaaagguggagguaacuccuaauucaccaagagcugaagccacccuugggggauucggcagucuggguuuggauugugagcccaggacagggcucgacuuuagcgaucuguauuacuuaacuaugaacaauaaacauuggcugguucacaaggaaugguuccaugacauaccucucccauggcacgcuggcgccgauaccggaacaccgcacuggaacaauaaagaggcacuuguggaauuuaaggacgcccaugcuaagcggcagaccgucgugguccugggcucccaggagggggcggugcacacugcauuggccggagcucuagaggccgaaauggauggugcaaaaggcaagcuguucucugggcaucucaaaugccgccugaagauggacaaacuuagacugaagggaguuagcuauucauuguguacggccgcuuuuacauucaccaaggugcccgccgagacucuccacggcaccguaacagucgaagugcaguacgcagguaccgacgggccuugcaaaaucccaguucaaauggcgguggauaugcagacucugacacccgucggcagguuaauuacggcuaacccugugaucaccgagaguacugaaaacuccaagaugaugcuggagcuagacccacccuuuggagauagcuacauaguaauuggcgugggggacaaaaagaucacacaucacuggcaccguucuggaucaaccaucgguaaagccuucgaggcaacaguucggggcgccaagcgaauggcuguccucggggauacugccugggacuucggaagugugggcgguguguuuaauagccuggggaagggcauucaucagaucuucggagcagcuuuuaaaucccuuuucggcgggaugucuugguuuucgcaaauuuugauaggaacccugcucgucuggcugggccuuaacacgaagaaugguagcaucucccugaccuguuuggcccucgggggaguuaugauuuuccugucaacagcggugagugccgaugugggcugcucuguagacuuuagcaaaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8371 - RNA, 2365 nt, Artificial Sequence
  LC002520.1 prME-long mRNA Design 3 opt
gggagaaagcuuaccaugagaaucauuaacgccaggaaggagcggaaacgccgaggcgcugacaccagcauagggaucauuggacugcuccuuacaacugcaauggccgcggaaaucacgcguagagguuccgcuuacuauauguaccuggauaggucugacgccggcaaggcaauuucauucgccaccacauugggggugaauaaaugccacguccagaucauggauuuaggacauaugugugacgcuacuaugaguuaugagugccccaugcuggaugaaggcguugagccugacgauguggacuguuggugcaacaccacaagcaccuggguaguguacgguacuugucaccauaagaaaggggaagcacggcgcuccagaagggccgucacacuaccaucucacucgacccggaagcuccaaacgcgcucacagacuuggcuggagagccgagaguauaccaagcaucuuauaaaaguggaaaauuggaucuuuagaaacccgggauucgcucugguugccguggcgauugcaugguugcucggcaguuccacaucucagaaggucaucuaccuggugaugauucugcucaucgcccccgcuuauagcauaaggugcauuggcguauccaaucgggauuuuguugaggggaugucaggagguacuuggguggacgucguguuagaacacggcgggugugugaccgucauggcccaggauaaaccuacaguugacaucgagcuggugaccacgacuguaaguaacauggcagaggugcguagcuacugcuacgaggcuucuauuuccgauauggccucagacagccgcuguccaacacaaggagaagcguaucuugacaagcagagugauacccaguacgucugcaaaagaacuuugguggacaggggcugggguaauggguguggacuguucggcaagggcucucuaguuacaugcgccaaguuuaccugcuccaaaaagaugacggggaaaagcauccagcccgaaaaccucgaguaucggaucaugcugucggugcacggaucucaacauuccgguaugaccgucaaugauauuggcuacgaaacagacgagaaccgagcaaagguggagguaacuccuaauucaccacgcgcugaagccacccuugggggauucggcagucuggguuuggauugugagcccagaacagggcucgacuuuagcgaucuguauuacuuaacuaugaacaauaaacacuggcugguucauaaggaaugguuccacgacauaccucucccauggcacgcuggcgccgauaccggaacaccgcauuggaacaauaaagaggcacuuguggaauuuaaggacgcccacgcuaagaggcagaccgucgugguccugggcucccaggagggggcggugcauacugcauuggccggagcucuagaggccgaaauggauggugcaaaaggcaagcuguucucugggcaccucaaaugccggcugaagauggacaaacuucgccugaagggaguuagcuauucauuguguacggccgcuuuuacauucaccaaggugcccgccgagacucuccauggcaccguaacagucgaagugcaguacgcagguaccgacgggccuugcaaaaucccaguucaaauggcgguggauaugcagacucugacacccgucggcagauuaauuacggcuaacccugugaucaccgagaguacugaaaacuccaagaugaugcuggagcuagacccacccuuuggagauagcuacauaguaauuggcgugggggacaaaaagaucacacaccacuggcauaggucuggaucaaccaucgguaaagccuucgaggcaacaguucguggcgccaagcggauggcuguccucggggauacugccugggacuucggaagugugggcgguguguuuaauagccuggggaagggcauucaccagaucuucggagcagcuuuuaaaucccuuuucggcgggaugucuugguuuucgcaaauuuugauaggaacccugcucgucuggcugggccuuaacacgaagaaugguagcaucucccugaccuguuuggcccucgggggaguuaugauuuuccugucaacagcggugagugccgaugugggcugcucuguagacuuuagcaaaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8372 - RNA, 2353 nt, Artificial Sequence
  KU963573.2 prME-long mRNA Design 3 opt
gggagaaagcuuaccaugagaaucauuaacgccaggaaggagcggaaacgccgaggcgcugacaccagcauagggaucauuggacugcuccuuacaacugcaauggccgcggaaaucacgcguagagguuccgcuuacuauauguaccuggauaggucugacgccggcaaggcaauuucauucgccaccacauugggggugaauaaaugccacguccagaucauggauuuaggacauaugugugacgcuacuaugaguuaugagugccccaugcuggaugaaggcguugagccugacgauguggacuguuggugcaacaccacaagcaccuggguaguguacgguacuugucaccauaagaaaggggaagcacggcgcuccagaagggccgucacacuaccaucucacucgacccggaagcuccaaacgcgcucacagacuuggcuggagagccgagaguauaccaagcaucuuauaaaaguggaaaauuggaucuuuagaaacccgggauucgcucugguugccguggcgauugcaugguugcucggcaguuccacaucucagaaggucaucuaccuggugaugauucugcucaucgcccccgcuuauagcauaaggugcauuggcguauccaaucgggauuuuguugaggggaugucaggagguacuuggguggacgucguguuagaacacggcgggugugugaccgucauggcccaggauaaaccuacaguugacaucgagcuggugaccacgacuguaaguaacauggcagaggugcguagcuacugcuacgaggcuucuauuuccgauauggccucagacagccgcuguccaacacaaggagaagcguaucuugacaagcagagugauacccaguacgucugcaaaagaacuuugguggacaggggcugggguaauggguguggacuguucggcaagggcucucuaguuacaugcgccaaguuuaccugcuccaaaaagaugacggggaaaagcauccagcccgaaaaccucgaguaucggaucaugcugucggugcacggaucucaacauuccgguaugauuggcuacgaaaccgaugagaaucgagcaaaggucgaggugacaccuaacucaccacgcgcugaagccacucuugggggauucggcagucuggguuuggacugugagcccagaaccgggcucgauuuuagcgaccuguauuacuuaacaaugaauaacaaacacuggcugguacauaaggaaugguuccacgauauaccucucccauggcacgcuggcgccgacacuggaaccccgcauuggaauaacaaagaggcacuuguugaauuuaaggaugcccacgcuaagaggcagacaguggucgugcugggcucccaggagggggcgguccauaccgcauuggccggagcucuagaggccgaaauggacggugcaaaaggcaagcuguucucugggcaccucaaaugccggcugaagauggauaaacuucgccugaagggagugagcuauucauuguguacugccgcuuuuacguucacaaagguucccgccgagacccuccauggcacugugaccguagaaguccaguacgcagguacagacgggccuugcaaaaucccagugcaaauggcgguugacaugcagacccugacucccgugggcagauuaauuacagcuaauccugucaucacggagaguaccgaaaacuccaagaugaugcuggagcuagauccacccuuuggagacagcuacauagugauuggcguaggggauaaaaagaucacucaccacuggcauaggucuggaucaacaaucgguaaagccuucgaggcaaccgugcguggcgccaagcggauggcuguucucggggacacagccugggauuucggaagugucggcgguguguuuaacagccuggggaagggcauucaccagaucuucggagcagcuuuuaaaucccuuuucggcgggaugucuugguuuucgcaaauuuugauaggaacucugcucguguggcugggccuuaauaccaagaacgguagcaucucccugacguguuuggcccucgggggagucaugauuuuccugucaaccgcgguuagugccgacgugggcugcucuguggauuuuagcaaaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8373 - RNA, 2365 nt, Artificial Sequence
  KX694534.2 prME-long mRNA Design 3 opt
gggagaaagcuuaccaugagaaucauuaacgccaggaaggagaaaaagcggcgcggcgcugacaccagcguggggauagucggacugcuccuuacaacugcaauggccgcggaaguuacgcgacgugguuccgcuuacuauauguaccuggauagaaaugacgccggcgaggcaaucucuuuccccaccacauuggggaugaacaaaugcuauauucagaucauggauuuaggacacaugugugacgccacuaugucauacgaaugcccuaugcuggaugagggcguggaaccagacgauguagacuguuggugcaauaccacaaguaccuggguggucuaugguacuugucaucacaagaaaggggaggcuaggcggagccgcagagcagugacacuaccgucccauucuaccaggaagcuccaaacgcggucgcagacuuggcuggagucacgcgaauacaccaagcaccuuauucgaguugagaacuggaucuuuagaaaucccggauucgcccuggcugccgcggcaauagccugguugcucggcagcaguacaucccagaaagugaucuaucuggucaugauucugcucaucgcuccugccuacucuauuaggugcaucggcgugagcaaccgggauuuuguagaagggauguccggagguacuuggguugacguggucuuagagcauggcgggugugugaccgugauggcacaggauaagccaacagucgacauagagcugguuaccacgacugugucaaauauggcugaaguacguaguuacugcuaugaggccagcauuucugauauggcguccgacucacgcugucccacacaaggagaagccuaccuugacaaacagagcgauacccaguaugugugcaagagaacuuuggucgacaggggcugggguaacggguguggacuguucggcaaaggcagucuagugacaugcgcaaaguuugcuugcucuaagaaaaugaccgggaaguccauccagccugagaaucucgaauaccggauuaugcugagcguucacggaucgcaacacucugguaugaucgugaacgauacgggccaugagaccgacgagaaucgagccaaagucgaaaucacaccaaacucaccccgcgcugaggccacucuugggggauucggcucccuggguuuggauugugaaccuagaaccgggcucgacuuuagugaucuguauuacuuaacaaugaauaacaagcacuggcuggugcauaaagagugguuccacgacauuccacucccguggcacgcaggcgccgauacuggaacaccccauuggaauaacaaggaagcucuuguagaguuuaaagacgcgcacgcaaagaggcagaccguugugguccugggcagccaggagggggccgugcauaccgcuuuggccggagcacuagaagccgagauggauggugcuaagggccggcuguccucugggcaccucaaaugccgccugaagauggacaaacuuagacugaagggagucagcuauucauuguguacugccgcauucacguuuacaaaaauaccugcggaaacccuccauggcacugugaccguugaggugcaguacgcugguacagacgggccaugcaagguacccgcccaaauggcagucgauaugcagacccugacuccugugggcagguuaaucacagccaacccaguuauuacggaaaguaccgaaaauuccaagaugaugcuggagcuagaucccccguucggagacagcuacaucgugauaggcgucggggagaaaaagauuacucaccacuggcaucguucuggaucaacaaucgguaaggcuuuugaggccaccgugcggggcgcaaaacgaauggcuguacucggggacacagccugggauuucggaagugugggcggugcgcugaacagccuugggagaggcauccaccagauuuucggagccgcuuuuaaauccuuguucggcgggaugucuugguuuucgcaaauccugauuggaacucuccugauguggcuuggccugaauaccaagaacgguagcauauccuugaugugucucgcauuagggggaguucugaucuuccugucaacggccgucagugcugacgugggcugcucuguggauuuuagcaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8374 - RNA, 2365 nt, Artificial Sequence
  KX447520.1 prME-long mRNA Design 3 opt
gggagaaagcuuaccaugagaaucauuaacgccaggaaggagaaaaagcggcgcggcgcugacgcaagcguggggauagucggacugcuccuuaccacagccauggcggcugaaguuacucgacgugguuccgccuacuauauguaccuggauagaaaugacgcaggcgaggccaucucuuuccccacgaccuuggggaugaacaaaugcuauauucagaucauggauuuaggacacaugugugacgcuacaaugucauacgaaugcccuaugcuggaugagggcguggaaccagacgauguagacuguuggugcaauacuaccaguacauggguggucuaugguaccugucaucacaagaaaggggaggcaaggcggagccgcagagccgugacucuaccgucccauucuacaaggaagcuccaaacccggucgcagacguggcuggagucacgcgaauacacuaagcaccuuauucgaguugagaacuggaucuuuagaaaucccggauucgcucuggccgcggcagccauagcuugguugcucggcagcaguaccucccagaaagugaucuaucuggucaugauucugcucaucgccccugcauacucuauuaggugcaucggcgugagcaaccgggauuuuguagaagggauguccggagguacauggguugacguggucuuagagcauggcgggugugugacugugauggcucaggauaagccaaccgucgacauagagcugguuacaaccacggugucaaauauggccgaaguacguaguuacugcuaugaggcgagcauuucugauauggccuccgacucacgcugucccacucaaggagaagcauaccuugacaaacagagcgauacacaguaugugugcaagagaaccuuggucgacaggggcugggguaacggguguggacuguucggcaaaggcagucuagugacuugcgcuaaguuugccugcucuaagaaaaugacagggaaguccauccagccugagaaucucgaauaccggauuaugcugagcguucacggaucgcaacacucugguaugaucgugaacgauaccggccaugagacggacgagaaucgagcuaaagucgaaaucaccccaaacucaccccgcgccgaggcaacacuugggggauucggcucccuggguuuggauugugaaccuagaacugggcucgacuuuagugaucuguauuacuuaaccaugaauaacaagcacuggcuggugcauaaagagugguuccacgacauuccacucccguggcacgccggcgcugauacaggaacuccccauuggaauaacaaggaagcgcuuguagaguuuaaagacgcacacgccaagaggcagaccguugugguccugggcagccaggagggggcugugcauacagccuuggcaggagcccuagaagcugagauggauggugccaagggccggcuguccucugggcaccucaaaugccgccugaagauggacaaacuuagacugaagggagucagcuauucauuguguaccgcagcguucacuuuuacgaaaauaccugcugaaacacuccauggcaccgugacuguugaggugcaguacgccgguaccgacgggccaugcaagguacccgcacaaauggccgucgauaugcagacacugaccccugugggcagguuaaucacugcuaacccaguuauuacagaaaguacggaaaauuccaagaugaugcuggagcuagaucccccguucggagacagcuacaucgugauaggcgucggggagaaaaagauuacccaccacuggcaucguucuggaucaacuaucgguaaagccuuugaggcaacagugcggggcgcuaagcgaauggccguacucggggacaccgcgugggauuucggaagugugggcggugcccugaacagccuugggaaaggcauccaccagauuuucggagcugcauuuaaguccuuguucggcgggaugucuugguuuucgcaaauccugauuggaacacuccugauguggcuuggccugaauacuaagaacgguagcauauccuugaugugucucgccuuagggggaguucugaucuuccugucaaccgcugucagugccgacgugggcugcucuguggauuuuagcaaaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8375 - RNA, 2365 nt, Artificial Sequence
  KX369547.1 prME-long mRNA Design 3 opt
gggagaaagcuuaccaugagaaucauuaacgccaggaaggagaaaaagcggcgcggcgcugacaccagcguggggauagucggacugcuccuuacaacugcaauggccgcggaaguuacgcgacgugguuccgcuuacuauauguaccuggauagaaaugacgccggcgaggcaaucucuuuccccaccacauuggggaugaacaaaugcuauauucagaucauggauuuaggacacaugugugacgccacuaugucauacgaaugcccuaugcuggaugagggcguggaaccagacgauguagacuguuggugcaauaccacaaguaccuggguggucuaugguacuugucaucacaagaaaggggaggcuaggcggagccgcagagcagugacacuaccgucccauucuaccaggaagcuccaaacgcggucgcagacuuggcuggagucacgcgaauacaccaagcaccuuauucgaguugagaacuggaucuuuagaaaucccggacuggccuuggcugccgcggcaauagccuggcuccugggcagcaguacaucccagaaagugaucuaucuggucaugauucucuuaaucgcuccugccuacucuauuaggugcaucggcgugagcaaccgggauuucguagaagggauguccggagguacuuggguugacgugguccuggagcauggcgggugugugaccgugauggcacaggauaagccaacagucgacauagagcuuguuaccacgacugugucaaauauggcugaaguacguaguuacugcuaugaggccagcauuucugauauggcguccgacucacgcugucccacacaaggagaagccuacuuggacaaacagagcgauacccaguaugugugcaagagaacucuggucgacaggggcugggguaacggguguggacuauuuggcaaaggcagucucgugacaugcgcaaaguucgcuugcucuaagaaaaugaccgggaaguccauccagccugagaaucuggaauaccggauuaugcuuagcguucacggaucgcaacacucugguaugaucgugaacgauacgggccaugagaccgacgagaaucgagccaaagucgaaaucacaccaaacucaccccgcgcugaggccacucugggaggguuuggcuccuugggucucgauugugaaccuagaaccgggcuggacuucagugauuuauauuaccugacaaugaauaacaagcacuggcucgugcauaaagagugguuucacgacauuccacuuccguggcacgcaggcgccgauacuggaacaccccauuggaauaacaaggaagcucugguagaguucaaagacgcgcacgcaaagaggcagaccguuguggucuugggcagccaggagggggccgugcauaccgcucuagccggagcacuggaagccgagauggauggugcuaagggccggcucuccucugggcaccugaaaugccgccuuaagauggacaaacugagauugaagggagucagcuauucacucuguacugccgcauuuacguucacaaaaauaccugcggaaacccugcauggcacugugaccguugaggugcaguacgcugguacagacgggccaugcaagguacccgcccaaauggcagucgauaugcagaccuuaacuccugugggcaggcugaucacagccaacccaguuauuacggaaaguaccgaaaauuccaagaugaugcuagagcucgaucccccguuuggagacagcuacaucgugauaggcgucggggagaaaaagauuacucaccacuggcaucguucuggaucaacaaucgguaaggcuuucgaggccaccgugcggggcgcaaaacgaauggcuguacugggggacacagccugggauuuuggaagugugggcggugcgcuuaacagcuuggggaaaggcauccaccagauuuucggagccgcuuucaagucccuguuuggcgggaugucuugguucucgcaaauccucauuggaacucugcuuauguggcugggcuugaauaccaagaacgguagcauaucccucaugugucuggcauuagggggaguucugaucuuucuaucaacggccgucagugcugacgugggcugcucuguggauuucagcaaaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8376 - RNA, 2365 nt, Artificial Sequence
  KX447515.1 prME-long mRNA Design 3 opt
gggagaaagcuuaccaugagaaucauuaacgccaggaaggagaaaaagcggcgcggcgcugacaccagcguggggauagucggacugcuccuuacaacugcaauggccgcggaaguuacgcgacgugguuccgcuuacuauauguaccuggauagaaaugacgccggcgaggcaaucucuuuccccaccacauuggggaugaacaaaugcuauauucagaucauggauuuaggacacaugugugacgccacuaugucauacgaaugcccuaugcuggaugagggcguggaaccagacgauguagacuguuggugcaauaccacaaguaccuggguggucuaugguacuugucaucacaagaaaggggaggcuaggcggagccgcagagcagugacacuaccgucccauucuaccaggaagcuccaaacgcggucgcagacuuggcuggagucacgcgaauacaccaagcaccuuauucgaguugagaacuggaucuuuagaaaucccggauucgcccuggcugccgcggcaauagccugguugcucggcagcaguacaucccagaaagugaucuaucuggucaugauucugcucaucgcuccugccuacucuauuaggugcaucggcgugagcaaccgggauuuuguagaagggauguccggagguacuuggguugacguggucuuagagcauggcgggugugugaccgugauggcacaggauaagccaacagucgacauagagcugguuaccacgacugugucaaauauggcugaaguacguaguuacugcuaugaggccagcauuucugauauggcguccgacucacgcugucccacacaaggagaagccuaccuugacaaacagagcgauacccaguaugugugcaagagaacuuuggucgacaggggcugggguaacggguguggacuguucggcaaaggcagucuagugacaugcgcaaaguuugcuugcucuaagaaaaugaccgggaaguccauccagccugagaaucucgaauaccggauuaugcugagcguucacggaucgcaacacucugguaugaucgugaacgauacgggccaugagaccgacgagaaucgagccaaagucgaaaucacaccaaacucaccccgcgcugaggccacucuugggggauucggcucccuggguuuggauugugaaccuagaaccgggcucgacuuuagugaucuguauuacuuaacaaugaauaacaagcacuggcuggugcauaaagagugguuccacgacauuccacucccguggcacgcaggcgccgauacuggaacaccccauuggaauaacaaggaagcucuuguagaguuuaaagacgcgcacgcaaagaggcagaccguugugguccugggcagccaggagggggccgugcauaccgcuuuggccggagcacuagaagccgagauggauggugcuaagggccggcuguccucugggcaccucaaaugccgccugaagauggacaaacuuagacugaagggagucagcuauucauuguguacugccgcauucacguuuacaaaaauaccugcggaaacccuccauggcacugugaccguugaggugcaguacgcugguacagacgggccaugcaagguacccgcccaaauggcagucgauaugcagacccugacuccugugggcagguuaaucacagccaacccaguuauuacggaaaguaccgaaaauuccaagaugaugcuggagcuagaucccccguucggagacagcuacaucgugauaggcgucggggagaaaaagauuacucaccacugguaucguucuggaucaacaaucgguaaggcuuuugaggccaccgugcggggcgcaaaacgaauggcuguacucggggacacagccugggauuucggaagugugggcggugcgcugaacagccuugggaaaggcauccaucagauuuucggagccgcuuuuaaguccuuguucggcgggaugucuugguuuucgcaaauccugauuggaacucuccugauguggcuuggccugaauaccaagaacgguagcauauccuugaugugucucgcauuagggggaguucugaucuuccugucaacggccgucagugcugacgugggcugcucuguggauuuuagcaaaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8377 - RNA, 2365 nt, Artificial Sequence
  KU501217.1 prME-long mRNA Design 3 opt
gggagaaagcuuaccaugagaaucauuaacgccaggaaggagaaaaagcggcgcggcgcugacaccagcguggggauagucggacugcuccuuacaacugcaauggccgcggaaguuacgcgacgugguuccgcuuacuauauguaccuggauagaaaugacgccggcgaggcaaucucuuuccccaccacauuggggaugaacaaaugcuauauucagaucauggauuuaggacacaugugugacgccacuaugucauacgaaugcccuaugcuggaugagggcguggaaccagacgauguagacuguuggugcaauaccacaaguaccuggguggucuaugguacuugucaucacaagaaaggggaggcuaggcggagccgcagagcagugacacuaccgucccauucuaccaggaagcuccaaacgcggucgcagacuuggcuggagucacgcgaauacaccaagcaccuuauucgaguugagaacuggaucuuuagaaaucccggauucgcccuggcugccgcggcaauagccugguugcucggcagcaguacaucccagaaagugaucuaucuggucaugauucugcucaucgcuccugccuacucuauuaggugcaucggcgugagcaaccgggauuuuguagaagggauguccggagguacuuggguugacguggucuuagagcauggcgggugugugaccgugauggcacaggauaagccaacagucgacauagagcugguuaccacgacugugucaaauauggcugaaauucguaguuacugcuaugaggccagcaucucugauauggcguccgacucacgcugucccacacaaggagaagccuaccuugacaaacagagcgauacccaguauguaugcaagagaacuuugguggacaggggcugggguaacggguguggacuguucggcaaaggcagucuagucacaugcgcaaaguuugcuugcucuaagaaaaugaccgggaaguccauucagccugagaaucucgaauaccggaucaugcugagcgugcacggaucgcaacacucugguaugaucguuaacgauacgggccaugagaccgacgagaaucgagccaaaguggaaauuacaccaaacucaccccgcgcugaggccacucuugggggauucggcucccuggguuuggauugugaaccuagaaccgggcucgacuuuagugaucuguauuacuuaacaaugaauaacaagcacuggcugguccauaaagagugguuccacgacauaccacucccguggcacgcaggcgccgauacuggaacaccccauuggaauaacaaggaagcucuuguggaguuuaaagacgcgcacgcaaagaggcagaccguaguugugcugggcagccaggagggggccguccauaccgcuuuggccggagcacuagaagccgagauggauggugcuaagggccggcuguccucugggcaccucaaaugccgccugaagauggacaaacuuagacugaagggagugagcuauucauuguguacugccgcauucacguuuacaaaaaucccugcggaaacccuccauggcacugucaccguggagguucaguacgcugguacagacgggccaugcaaggugcccgcccaaauggcaguagauaugcagacccugacuccugucggcagguuaauuacagccaacccagugaucacggaaaguaccgaaaauuccaagaugaugcuggagcuagaucccccguucggagacagcuacauaguuauuggcgugggggagaaaaagaucacucaccacuggcaucguucuggaucaacaaucgguaaggcuuuugaggccaccguccggggcgcaaaacgaauggcugugcucggggacacagccugggauuucggaaguguaggcggugcgcugaacagccuugggaaaggcauucaccagaucuucggagccgcuuuuaaguccuuguucggcgggaugucuugguuuucgcaaauucugauaggaacucuccugauguggcuuggccugaauaccaagaacgguagcaucuccuugaugugucucgcauuagggggagugcugauuuuccugucaacggccguuagugcugacgucggcugcucuguggauuuuagcaaaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8378 - RNA, 2365 nt, Artificial Sequence
  KU312314.1 prME-long mRNA Design 3 opt
gggagaaagcuuaccaugagaaucauuaacgccaggaaggagaaaaagcggcgcggcgcugacaccagcguggggauagucggacugcuccuuacaacugcaauggccgcggaaguuacgcgacgugguuccgcuuacuauauguaccuggauagaaaugacgccggcgaggcaaucucuuuccccaccacauuggggaugaacaaaugcuauauucagaucauggauuuaggacacaugugugacgccacuaugucauacgaaugcccuaugcuggaugagggcguggaaccagacgauguagacuguuggugcaauaccacaaguaccuggguggucuaugguacuugucaucacaagaaaggggaggcuaggcggagccgcagagcagugacacuaccgucccauucuaccaggaagcuccaaacgcggucgcagacuuggcuggagucacgcgaauacaccaagcaccuuauucgaguugagaacuggaucuuuagaaaucccggauucgcccuggcugccgcggcaauagccugguugcucggcagcaguacaucccagaaagugaucuaucuggucaugauucugcucaucgcuccugccuacucuauuaggugcaucggcgugagcaaccgggauuuuguagaagggauguccggagguacuuggguugacguggucuuagagcauggcgggugugugaccgugauggcacaggauaagccaacagucgacauagagcugguuaccacgacugugucaaauauggcugaaguacguaguuacugcuaugaggccagcauuucugauauggcguccgacucacgcugucccacacaaggagaagccuaccuugacaaacagagcgauacccaguaugugugcaagagaacuuuggucgacaggggcugggguaacggguguggacuguucggcaaaggcagucuagugacaugcgcaaaguuugcuugcucuaagaaaaugaccgggaaguccauccagccugagaaucucgaauaccggauuaugcugagcguucacggaucgcaacacucugguaugaucgugaacgauacgggccaugagaccgacgagaaucgagccaaagucgaaaucacaccaaacucaccccgcgcugaggccacucuugggggauucggcucccuggguuuggauugugaaccuagaaccgggcucgacuuuagugaucuguauuacuuaacaaugaauaacaagcacuggcuggugcauaaagagugguuccacgacauuccacucccguggcacgcaggcgccgauacuggaacaccccauuggaauaacaaggaagcucuuguagaguuuaaagacgcgcacgcaaagaggcagaccguugugguccugggcagccaggagggggccgugcauaccgcuuuggccggagcacuagaagccgagauggauggugcuaagggccggcuguccucugggcaccucaaaugccgccugaagauggacaaacuuagacugaagggagucagcuauucauuguguacugccgcauucacguuuacaaaaauaccugcggaaacccuccauggcacugugaccguugaggugcaguacgcugguacagacgggccaugcaagguacuggcccaaauggcagucgauaugcagaccuuaacucccgugggcaggcugaucacagccaacccuguuauuacggaaaguaccgaaaauuccaagaugaugcuagagcucgacccacccuucggagauagcuacaucgugauaggcgucggggagaaaaagauuacucaccacuggcaucguucuggaucaacaaucgguaaggcuuuugaggccaccgugcggggcgcaaaacgaauggcuguacugggggacacagccugggauuucggaagugugggcggugcgcuuaacagcuuggggaaaggcauccaccagauuuucggagccgcuuuuaagucccuguucggcgggaugucuugguuuucgcaaauccucauuggaacucugcuuauguggcugggcuugaauaccaagaacgguagcauaucccucaugugucuggcauuagggggaguucugaucuuccuaucaacggccgucagugcugacgugggcugcucuguggauuuuagcaaaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8379 - RNA, 2365 nt, Artificial Sequence
  KX446950.2 prME-long mRNA Design 3 opt
gggagaaagcuuaccaugagaaucauuaacgccaggaaggagaaaaagcggcgcggcgcugacaccagcguggggauagucggacugcuccuuacaacugcaauggccgcggaaguuacgcgacgugguuccgcuuacuauauguaccuggauagaaaugacgccggcgaggcaaucucuuuccccaccacauuggggaugaacaaaugcuauauucagaucauggauuuaggacacaugugugacgccacuaugucauacgaaugcccuacccuggaugagggcguggaaccagacgauguagacuguuggugcaauacaaccaguacuuggguggucuaugguacaugucaucacaagaaaggggaggcuaggcggagccgcagagcagugacccuaccgucccauucuacgaggaagcuccaaacucggucgcagaccuggcuggagucacgcgaauacacaaagcaccuuauucgaguugagaacuggaucuuuagaaaucccggauucgcccuggcugccgcggcaauagccugguugcucggcagcaguacuucccagaaagugaucuaucuggucaugauucugcucaucgcuccugccuacucuauuaggugcaucggcgugagcaaccgggauuuuguagaagggauguccggagguaccuggguugacguggucuuagagcauggcgggugugugacagugauggcacaggauaagccaaccgucgacauagagcugguuacgacuacagugucaaauauggcugaaguacguaguuacugcuaugaggccagcauuucugauauggcguccgacucacgcugucccacccaaggagaagccuaccuugacaaacagagcgauacucaguaugugugcaagagaacauuggucgacaggggcugggguaacggguguggacuguucggcaaaggcagucuagugaccugcgcaaaguuugcuugcucuaagaaaaugacggggaaguccauccagccugagaaucucgaauaccggauuaugcugagcguucacggaucgcaacacucugguaugaucgugaacgauaccggccaugagacagacgagaaucgagccaaagucgaaaucacuccaaacucaccccgcgcugaggccacccuugggggauucggcucccuggguuuggauugugaaccuagaacagggcucgacuuuagugaucuguauuacuuaacuaugaauaacaagcacuggcuggugcauaaagagugguuccacgacauuccacucccguggcacgcaggcgccgauaccggaacaccccauuggaauaacaaggaagcucuuguagaguuuaaagacgcgcacgcaaagaggcagaccguugugguccugggcagccaggagggggccgugcauacugcuuuggccggagcacuagaagccgagauggauggugcuaagggccggcuguccucugggcaccucaaaugccgccugaagauggacaaacuuagacugaagggagucagcuauucauuguguacggccgcauucacauuuaccaaaauaccugcggaaacucuccauggcaccgugacaguugaggugcaguacgcugguaccgacgggccaugcaagguacccgcccaaauggcagucgauaugcagacucugacaccugugggcagguuaaucacggccaacccaguuauuaccgaaaguacugaaaauuccaagaugaugcuggagcuagaucccccguucggagacagcuacaucgugauaggcgucggggagaaaaagauuacacaccacuggcaucguucuggaucaaccaucgguaaggcuuuugaggccacagugcggggcgcaaaacgaauggcuguacucggggacacugccugggauuucggaagugugggcggugcgcugaacagccuugggaaaggcauccaccagauuuucggagccgcuuuuaaguccuuguucggcgggaugucuugguuuucgcaaauccugauuggaacccuccugauguggcuuggccugaauacgaagaacgguagcauauccuugaugugucucgcauuagggggaguucugaucuuccugucaaccgccgucagugcugacgugggcugcucuguggauuuuagcaaaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8380 - RNA, 2365 nt, Artificial Sequence
  KY003157.1 prME-long mRNA Design 3 opt
gggagaaagcuuaccaugagaaucauuaacgccaggaaggagaaaaagcggcgcggcgcugacaccagcguggggauagucggacugcuccuuacaacugcaauggccgcggaaguuacgcgacgugguuccgcuuacuauauguaccuggauagaaaugacgccggcgaggcaaucucuuuccccaccacauuggggaugaacaaaugcuauauucagaucauggauuuaggacacaugugugacgccacuaugucauacgaaugcccuaugcuggaugagggcguggaaccagacgauguagacuguuggugcaauaccacaaguaccuggguggucuaugguacuugucaucacaagaaaggggaggcuaggcggagccgcagagcagugacacuaccgucccauucuaccaggaagcuccaaacgcggucgcagacuuggcuggagucacgcgaauacaccaagcaccuuauucgaguugagaacuggaucuuuagaaaucccggauucgcccuggcugccgcggcaauagccugguugcucggcagcaguacaucccagaaagugaucuaucuggucaugauucugcucaucgcuccugccuacucuauuaggugcaucggcgugagcaaccgggauuuuguagaagggauguccggagguacuuggguugacguggucuuagagcauggcgggugugugaccgugauggcacaggauaagccaacagucgacauagagcugguuaccacgacugugucaaauauggcugaaguacguaguuacugcuaugaggccagcauuucugauauggcguccgacucacgcugucccacacaaggagaagccuaccuugacaaacagagcgauacccaguaugugugcaagagaacuuuggucgacaggggcugggguaacggguguggacuguucggcaaaggcagucuagugacaugcgcaaaguuugcuugcucuaagaaaaugaccgggaaguccauccagccugagaaucucgaauaccggauuaugcugagcguucacggaucgcaacacucugguaugaucgugaacgauacgggccaugagaccgacgagaaucgagccaaagucgaaaucacaccaaacucaccccgcgcugaggccacucuugggggauucggcucccuggguuuggauugugaaccuagaaccgggcucgacuuuagugaucuguauuacuuaacaaugaauaacaagcacuggcuggugcauaaagagugguuccacgacauuccacucccguggcacgcaggcgccgauacuggaacaccccauuggaauaacaaggaagcucuuguagaguuuaaagacgcgcacgcaaagaggcagaccguugugguccugggcagccaggagggggccgugcauaccgcuuuggccggagcacuagaagccgagauggauggugcuaagggccggcuguccucugggcaccucaaaugccgccugaagauggacaaacuuagacugaagggagucagcuauucauuguguacugccgcauucacguuuacaaaaauaccugcggaaacccuccauggcacugugaccguugaggugcaguacgcugguacagacgggccaugcaagguacccgcccaaauggcagucgauaugcagacccugacuccugugggcagguuaaucacagccaacccaguuauuacggaaaguaccgaaaauuccaagaugaugcuggagcuagaucccccguucggagacagcuacaucgugauaggcgucggggagaaaaagauuacucaccacuggcaucguucuggaucaacaaucgguaaggcuuuugaggccaccgugcggggcgcaaaacgaauggcuguacucggggacacagccugggauuucggaagugugggcggugcgcugaacagccuugggaaaggcauccaccagauuuucggagccgcuuuuaaguccuuguucggcgggaugucuugguuuucgcaaauccugauuggaacucuccugauguggcuuggccugaauaccaagaacgguagcauauccuugaugugucucgcauuagggggaguucugaucuuccugucaacggucgugagugccgacgugggcugcucugucgauuuuagcaaaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8381 - RNA, 2365 nt, Artificial Sequence
  KX811222.1 prME-long mRNA Design 3 opt
gggagaaagcuuaccaugagaaucauuaacgccaggaaggagaaaaagcggcgcggcgcugacaccagcguggggauagucggacugcuccuuacaacugcaauggccgcggaaguuacgcgacgugguuccgcuuacuauauguaccuggauagaaaugacgccggcgaggcaaucucuuuccccaccacauuggggaugaacaaaugcuauauucagaucauggauuuaggacacaugugugacgccacuaugucauacgaaugcccuaugcuggaugagggcguggaaccagacgauguagacuguuggugcaauaccacaagugcuuggguggucuaugguaccugucaucacaagaaaggggaggcaaggcggagccgcagagccgugacucuaccgucccauucuacaaggaagcuccaaacccggccccagacguggcuggagucgcgcgaauacacuaagcaccuuauucgaguugagaacuggaucuuuagaaauccuggauucgcucuggccgcggcagccauagcuugguugcucggcucaagcaccagucagaaagugaucuaucuggucaugauucugcucaucgccccagcauacuccauuaggugcaucggcgugucuaaccgggauuuuguagaagggaugagcggagguacauggguugacguggucuuagagcauggcgggugugugacugugauggcucaggauaagcccaccgucgacauagagcugguuacaaccacgguguccaauauggccgaaguacguucauacugcuaugaggcgaguauuagcgauauggccucugacucccgcuguccuacucaaggagaagcauaccuugacaaacagucagauacacaguaugugugcaagagaaccuuggucgacaggggcugggguaacggguguggacuguucggcaaaggcagccuagugacuugcgcuaaguuugccugcaguaagaaaaugacagggaagucuauccagccagagaaucucgaauaccggauuaugcuguccguucacggaagccaacacucggguaugaucgugaacgauaccggccaugagacggacgagaaucgagcuaaagucgaaaucacccccaacucuccucgcgccgaggcaacacuugggggauucggcucccuggguuuggauugugaaccaagaacugggcucgacuuuucagaucuguauuacuuaaccaugaauaacaagcacuggcuggugcauaaagagugguuccacgacauuccgcuccccuggcacgccggcgcugauacaggaacuccucauuggaauaacaaggaagcgcuuguagaguuuaaagacgcacacgccaagaggcagaccguugugguccugggcagucaggagggggcugugcauacagccuuggcaggagcccuagaagcugagauggauggugccaagggccggcugagcuccgggcaccucaaaugccgccugaagauggacaaacuuagacugaagggagucucuuauagcuuguguaccgcagcguucacuuuuacgaaaauaccagcugaaacacuccauggcaccgugacuguugaggugcaguacgccgguaccgacgggcccugcaagguaccugcacaaauggccgucgauaugcagacacugaccccagugggcagguuaaucacugcuaaccccguuauuacagaaucaacggagaauaguaagaugaugcuggagcuagacccgccuuucggagauuccuacaucgugauaggcgucggggagaaaaagauuacccaccacuggcaucguagcggaucuacuaucgguaaagccuuugaagcaacagugcggggcgcuaagcgaauggccguacucggggacaccgcgugggauuucggaucagugggcggugcccugaacagucuugggaaaggcauccaccagauuuucggagcugcauuuaagagcuuguucggcgggauguccugguuuucucaaauccugauuggaacacuccugauguggcuuggccugaauacuaagaacgguucgaucagcuugaugugucucgccuuagggggaguucugauauuccuguccaccgcugucucagccgacgugggcugcaguguggauuuuucuaaaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8382 - RNA, 2365 nt, Artificial Sequence
  KX447516.1 prME-long mRNA Design 3 opt
gggagaaagcuuaccaugagaaucauuaacgccaggaaggagaaaaagcggcgcggcgcugacaccagcguggggauagucggacugcuccuuacaacugcaauggccgcggaaguuacgcgacgugguuccgcuuacuauauguaccuggauagaaaugacgccggcgaggcaaucucuuuccccaccacauuggggaugaacaaaugcuauauucagaucauggauuuaggacacaugugugacgccacuaugucauacgaaugcccuaugcuggaugagggcguggaaccagacgauguagacuguuggugcaauaccacaaguaccuggguggucuaugguacuugucaucacaagaaaggggaggcuaggcggagccgcagagcagugacacuaccgucccauucuaccaggaagcuccaaacgcggucgcagacuuggcuggagucacgcgaauacaccaagcaccuuauucgaguugagaacuggaucuuuagaaaucccggauucgcccuggcugccgcggcaauagccugguugcucggcagcaguacauccaaaaaggugaucuaucuggucaugauucugcucaucgcuccugccuacucuauuaggugcaucggcgugagcaaccgggauuuuguagaagggauguccggagguacuuggguugacguggucuuagagcauggcgggugugugaccgugauggcacaggauaaaccaacagucgacauagagcugguuaccacgacugugucaaauauggcugaaguacguaguuacugcuaugaggccagcauuucugauauggcguccgacucacgcugucccacacagggagaagccuaccuugacaagcaaagcgauacccaguaugugugcaaaagaacuuuggucgacaggggcugggguaacggguguggacuguucggcaagggcagucuagugacaugcgcaaaguuugcuugcucuaaaaagaugaccgggaaauccauccagccugagaaucucgaauaccggauuaugcugagcguucacggaucgcagcacucugguaugaucgugaacgauacgggccaugagaccgacgagaaucgagccaaggucgaaaucacaccaaacucaccccgcgcugaggccacucuugggggauucggcucccuggguuuggauugugaaccuagaaccgggcucgacuuuagugaucuguauuacuuaacaaugaauaacaaacacuggcuggugcauaaggagugguuccacgacauuccacucccguggcacgcaggcgccgauacuggaacaccccauuggaauaacaaagaagcucuuguagaguuuaaggacgcgcacgcaaagaggcaaaccguugugguccugggcagccaggagggggccgugcauaccgcuuuggccggagcacuagaagccgagauggauggugcuaaaggccggcuguccucugggcaccucaagugccgccugaaaauggacaagcugagacugaaaggagucagcuauucauuguguacugccgcauucacguuuacaaagauaccugcggaaacccuccauggcacugugaccguugaggugcaguacgcugguacagacgggccaugcaagguacccgcccagauggcagucgauaugcaaacccugacuccugugggcagguuaaucacagccaacccaguuauuacggaaaguaccgaaaauuccaaaaugaugcuggagcuagaucccccguucggagacagcuacaucgugauaggcgucggggagaagaaaauuacucaccacuggcaucguucuggaucaacaaucgguaaggcuuuugaggccaccgugcggggcgcaaaacgaauggcuguacucggggacacagccugggauuucggaagugugggcggugcgcugaacagccuugggaagggcauccaccagauuuucggagccgcuuuuaaguccuuguucggcgggaugucuugguuuucgcagauccugauuggaacucuccugauguggcuuggccugaauaccaaaaacgguagcauauccuugaugugucucgcacuugggggaguuuuaaucuuccugucaacggccgucagugcugacgugggcugcucuguggauuuuagcaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8383 - RNA, 2365 nt, Artificial Sequence
  KX520666.1 prME-long mRNA Design 3 opt
gggagaaagcuuaccaugagaaucauuaacgccaggaaggagaaaaagcggcgcggcgcugacaccagcguggggauagucggacugcuccuuacaacugcaauggccgcggaaguuacgcgacgugguuccgcuuacuauauguaccuggauagaaaugacgccggcgaggcaaucucuuuccccaccacauuggggaugaacaaaugcuauauucagaucauggauuuaggacacaugugugacgccacuaugucauacgaaugcccuaugcuggaugagggcguggaaccagacgauguagacuguuggugcaauaccacaaguaccuggguggucuaugguacuugucaucacaagaaaggggaggcuaggcggagccgcagagcagugacacuaccgucccauucuaccaggaagcuccaaacgcggucgcagacuuggcuggagucacgcgaauacaccaagcaccuuauucgaguugagaacuggaucuuuagaaaucccggauucgcccuggcugccgcggcaauagccugguugcucggcagcaguacaaggcagaaagugaucuaucuggucaugauucugcucaucgcuccugccuacuccauucggugcaucggcgugucuaaccgugauuuuguagaagggaugagcggagguacuuggguugacguggucuuagagcauggcgggugugugaccgugauggcacaggauaagccaacagucgacauagagcugguuaccacgacuguguccaauauggcugaaguacgcucauacugcuaugaggccaguauuagcgauauggcgucugacuccagaugucccacacaaggagaagccuaccuugacaaacagucagauacccaguaugugugcaagaggacuuuggucgaccggggcugggguaacggguguggacuguucggcaaaggcagccuagugacaugcgcaaaguuugcuugcaguaagaaaaugaccgggaagucuauccagccugagaaucucgaauaccgaauuaugcuguccguucacggaagccaacacucggguaugaucgugaacgauacgggccaugagaccgacgagaaucgcgccaaagucgaaaucacaccaaacucucccagagcugaggccacucuugggggauucggcucccuggguuuggauugugaaccuaggaccgggcucgacuuuucagaucuguauuacuuaacaaugaauaacaagcacuggcuggugcauaaagagugguuccacgacauuccacucccguggcacgcaggcgccgauacuggaacaccccauuggaauaacaaggaagcucuuguagaguuuaaagacgcgcacgcaaagcggcagaccguugugguccugggcagucaggagggggccgugcauaccgcuuuggccggagcacuagaagccgagauggauggugcuaagggccgccugagcuccgggcaccucaaaugcagacugaagauggacaaacuuaggcugaagggagucucuuauagcuuguguacugccgcauucacguuuacaaaaauaccugcggaaacccuccauggcacugugaccguugaggugcaguacgcugguacagacgggccaugcaagguacccgcccaaauggcagucgauaugcagacccugacuccugugggccguuuaaucacagccaacccaguuauuacggaaucaaccgagaauaguaagaugaugcuggagcuagaucccccguucggagacuccuacaucgugauaggcgucggggagaaaaagauuacucaccacuggcaucggagcggaucuacaaucgguaaggcuuuugaagccaccgugcgaggcgcaaaaagaauggcuguacucggggacacagccugggauuucggaucagugggcggugcgcugaacagucuugggaaaggcauccaccagauuuucggagccgcuuuuaagagcuuguucggcgggauguccugguuuucucaaauccugauuggaacucuccugauguggcuuggccugaauaccaagaacgguucgaucagcuugaugugucucgcauuagggggaguucugauauuccuguccacggccgucucagcugacgugggcugcaguguggauuuuucuaaaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8384 - RNA, 2365 nt, Artificial Sequence
  KU729218.1 prME-long mRNA Design 3 opt
gggagaaagcuuaccaugagaaucauuaacgccaggaaggagaaaaagcggcgcagcgcugacaccuccgugggcauagucgggcugcuccuuacaacugcaauggccgcggaaguuacgcgacguggaucugcuuacuauauguaccuggauagaaaugacgccggugaggcaaucucauuccccaccacauugggcaugaacaaaugcuauauucagaucauggauuuagggcacaugugugacgccacuaugaguuacgaaugcccuaugcuggaugagggaguggaaccagacgauguagacuguuggugcaauaccacaagcaccuggguggucuauggcacuugucaucacaagaaaggugaggcuaggcggucccgcagagcagugacacuaccgucucauucgaccaggaagcuccaaacgcggucacagacuuggcuggagagccgcgaauacaccaagcaccuuauucgaguugagaacuggaucuuuagaaaucccggguucgcccuggcugccgcggcaauagccugguugcucggaaguuccacaucucagaaagugaucuaucuggucaugauucugcucaucgcuccugccuacagcauuaggugcaucggcguguccaaccgggauuuuguagaaggcaugucagggggaacuuggguugacguggucuuagagcaugguggcugugugaccgugauggcacaggauaagccaacagucgacauagagcugguuaccacgacugugaguaauauggcugaaguacguagcuacugcuaugaggccucuauuuccgauauggcgucagacagccgcugucccacacaaggggaagccuaccuugacaaacagagugauacccaguaugugugcaagagaacuuuggucgacaggggauggggcaacgguugugggcuguucggaaaaggcucucuagugacaugcgcaaaguuugcuugcuccaagaaaaugaccggcaagagcauccagccugagaaucucgaauaccggauuaugcugucgguucacgggucucaacacuccggaaugaucgugaacgauacgggucaugagaccgacgagaaucgagccaaagucgaaaucacaccaaacucaccccgcgcugaggccacucuuggcggguucggaagucugggcuuggauugugaaccuagaaccggucucgacuuuagcgaucuguauuacuuaacaaugaauaacaagcacuggcuggugcauaaagagugguuccacgacauuccacucccguggcacgcaggggccgauacuggcacaccccauuggaauaacaaggaagcucuuguagaguuuaaagacgcgcacgcaaagaggcagaccguugugguccugggaucccaggagggcgccgugcauaccgcuuuggccggggcacuagaagccgagauggauggagcuaagggucggcugucuagcggccaccucaaaugccgccugaagauggacaaacuuagacugaagggggucucauauaguuuguguacugccgcauucacguuuacaaaaauaccugcggaaacccuccauggaacugugaccguugaggugcaguacgcuggcacagacgguccaugcaagguacccgcccaaauggcagucgauacccagacucugacaccuguggggagguuaaucacggccaacccaguuauuaccgaauccacugagaauagcaagaugaugcuggagcuagaucccccguucggcgacucuuacaucgugauaggagucggcgagaaaaagauuacacaccacuggcaucguucagggaguaccaucggaaaggcuuuugaagccacagugcggggugcaaaacgaauggcuguacucggcgacacugccugggauuucgggagcgugggaggcgcgcugaacucccuugguaaagggauccaccagauuuucggcgccgcuuuuaagucuuuguucggaggcaugucgugguuuagccaaauccugauugggacccuccugauguggcuuggacugaauacgaagaacggcuccauaucauugaugugucucgcacugggugggguuuuaaucuuccugaguaccgccgucucugcugacgugggaugcagcguggauuuuuccaaaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8385 - RNA, 2365 nt, Artificial Sequence
  KU761561.1 prME-long mRNA Design 3 opt
gggagaaagcuuaccaugagaaucauuaacgccaggaaggagaaaaagcggcgcggcgcugacaccaauguggggauagucggacugcuccuuacaacugcaauggccgcggaaguuacgcgacgugguagcgcuuacuauauguaccuggauagaaacgacgccggcgaggcaaucuccuuccccaccacauuggggaugaauaaaugcuauauucagaucauggauuuaggacacaugugugacgccacuaugucuuacgaaugcccuaugcuggaugagggcguggaaccagacgauguagacuguuggugcaacaccacaucaaccuggguggucuaugguacuugucaucacaagaaaggggaggcuaggcggagucgcagagcagugacacuaccgagccauuccaccaggaagcuccaaacgcggucucagacuuggcuggagucgcgcgaauacaccaagcaccuuauucgaguugagaauuggaucuuuagaaaccccggauucgcccuggcugccgcggcaauagccugguugcucggcucaagcacaagucagaaagugaucuaucuggucaugauucugcucaucgcuccugccuacuccauuaggugcaucggcgugucuaaucgggauuuuguagaagggaugagcggagguacuuggguugacguggucuuagagcauggcgggugugugaccgugauggcacaggauaagccaacagucgacauagagcugguuaccacgacuguguccaacauggcugaaguacguucauacugcuaugaggccaguauuagcgauauggcgucugacucccgcugucccacacaaggagaagccuaccuugacaaacagucagauacccaguaugugugcaagagaacuuuggucgacaggggcugggguaauggguguggacuguucggcaaaggcagccuagugacaugcgcaaaguuugcuugcaguaagaaaaugaccgggaagucuauccagccugagaaccucgaauaccggauuaugcuguccguucacggaagccaacacucggguaugaucgugaaugauacgggccaugagaccgacgagaaccgagccaaagucgaaaucacaccaaauucuccccgcgcugaggccacucuugggggauucggcucccuggguuuggauugugaaccuagaaccgggcucgacuuuucagaucuguauuacuuaacaaugaacaauaagcacuggcuggugcauaaagagugguuccacgacauuccacucccguggcacgcaggcgccgauacuggaacaccccauuggaacaacaaggaagcucuuguagaguuuaaagacgcgcacgcaaagaggcagaccguugugguccugggcagucaggagggggccgugcauaccgcuuuggccggagcacuagaagccgagauggauggugcuaagggccggcugagcuccgggcaccucaaaugccgccugaagauggacaaacuuagacugaagggagucucuuauagcuuguguacugccgcauucacguuuacaaaaauaccugcggaaacccuccauggcacugugaccguugaggugcaguacgcugguacagacgggccaugcaagguacccgcccaaauggcagucgauaugcagacccugacuccugugggcagguuaaucacagccaauccaguuauuacggaaucaaccgagaacaguaagaugaugcuggagcuagaucccccguucggagacuccuacaucgugauaggcgucggggagaaaaagauuacucaccacuggcaucguagcggaucuacaaucgguaaggcuuuugaagccaccgugcggggcgcacgaagaauggcuguacucggggacacagccugggauuucggaucagugggcggugcgcugaauagucuugggaaaggcauccaccagauuuucggagccgcuuuuaagagcuuguucggcgggauguccugguuuucucaaauccugauuggaacucuccugauguggcuuggccugaacaccaaaaaugguucgaucagcuugaugugucucgcauuagggggaguucugauauuccuguccacggccgucucagcugacgugggcugcaguguggauuuuucuaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8386 - RNA, 2365 nt, Artificial Sequence
  KY317938.1 prME-long mRNA Design 3 opt
gggagaaagcuuaccaugagaaucauuaacgccaggaaggagaaaaagcggcgcggcgcugaaaccagcguggggauagucggacugcuccuuacaacugcaauggccgcggagguuacgcgacgugguuccgcuuacuauauguaccuggacagaaaugaugccggcgaagcaaucucuuuccccaccacauuggggaugaacaaaugcuauauucagaucauggacuuaggacacaugugugaugccacuaugucauacgagugcccuaugcuggacgaaggcguggagccagaugacguagauuguuggugcaauaccacaaguaccuggguggucuaugguacuugucaucacaagaaaggggaggcuaggcggagccgcagagcagugacacuaccgucccauucuaccaggaagcuccaaacgcggucgcagacuuggcuggaaucacgcgaguacaccaagcaccuuauucgaguugaaaacuggaucuuuagaaaucccggauucgcccuggcugccgcggcaauagccugguugcucggcagcaguacaucccagaaagugaucuaucuggucaugauucugcucaucgcuccugccuacucuauuaggugcaucggcgugagcaaccgggacuuuguagaggggauguccggagguacuuggguugauguggucuuagagcauggcgggugugugaccgugauggcacaggacaagccaacagucgauauagaacugguuaccacgacugugucaaauauggcugagguacguaguuacugcuaugaagccagcauuucugacauggcguccgauucacgcugucccacacaaggagaggccuaccuugacaaacagagcgacacccaguaugugugcaagagaacuuuggucgauaggggcugggguaacggguguggacuguucggcaaaggcagucuagugacaugcgcaaaguuugcuugcucuaagaaaaugaccgggaaguccauccagccugaaaaucucgaguaccggauuaugcugagcguucacggaucgcaacacucugguaugaucgugaacgacacgggccaugagaccgaugaaaaucgagccaaagucgagaucacaccaaacucaccccgcgcugaagccacucuugggggauucggcucccuggguuuggacugugagccuagaaccgggcucgauuuuagugaccuguauuacuuaacaaugaauaacaagcacuggcuggugcauaaagaaugguuccacgauauuccacucccguggcacgcaggcgccgacacuggaacaccccauuggaauaacaaggaggcucuuguagaguuuaaagaugcgcacgcaaagaggcagaccguugugguccugggcagccaggaaggggccgugcauaccgcuuuggccggagcacuagaggccgaaauggacggugcuaagggccggcuguccucugggcaccucaaaugccgccugaagauggauaaacuuagacugaagggagucagcuauucauuguguacugccgcauucacguuuacaaaaauaccugcggagacccuccauggcacugugaccguugaagugcaguacgcugguacagacgggccaugcaagguacccgcccaaauggcagucgacaugcagacccugacuccugugggcagguuaaucacagccaacccaguuauuacggagaguaccgaaaauuccaagaugaugcuggagcuagaucccccguucggagacagcuacaucgugauaggcgucggggagaaaaagauuacucaccacuggcaucguucuggaucaacaaucgguaaggcuuuugaagccaccgugcggggcgcaaaacgaauggcuguacucggggauacagccugggacuucggaagugugggcggugcgcugaacagccuugggaaaggcauccaccagauuuucggagccgcuuuuaaguccuuguucggcgggaugucuugguuuucgcaaauccugauuggaacucuccugauguggcuuggccugaauaccaagaacgguagcauauccuugaugugucucgcauuagggggaguucugaucuuccugucaacggccgucagugcugaugugggcugcucuguggacuuuagcaaaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8387 - RNA, 2365 nt, Artificial Sequence
  KY075939.1 prME-long mRNA Design 3 opt
gggagaaagcuuaccaugagaaucauuaacgccaggaaggagaaaaagcggcgcggcgcugacaccagcguggggauagucggacugcuccuuacaacugcaauggccgcggaaguuacgcgacgugguuccgcuuacuauauguaccuggauagaaaugacgccggcgaggcaaucucuuuccccaccacauuggggaugaacaaaugcuauauucagaucauggauuuaggacacaugugugacgccacuaugucauacgaaugcccuaugcuggaugagggcguggaaccagacgauguagacuguuggugcaauaccacaaguaccuggguggucuaugguacuugucaucacaagaaaggggaggcuaggcggagccgcagagcagugacacuaccgucccauucuaccaggaagcuccaaacgcggucgcagacuuggcuggagucacgcgaauacaccaagcaccuuauucgaguugagaacuggaucuuuagaaaucccggauucgcccuggcugccgcggcaauagccugguugcucggcagcaguacaucccagaaagugaucuaucuggucaugauucugcucaucgcuccugccuacucuuuaaggugcauuggcgugagcaaccgggauuuuguagaagggauguccggagguacuuggguugacgugguccuggagcauggcgggugugugaccgugauggcacaggauaagccaacagucgacaucgagcuuguuaccacgacugugucaaauauggcugaaguacguaguuacugcuaugaggccagcauaucugauauggcguccgacucacgcugucccacacaaggagaagccuacuuggacaaacagagcgauacccaguaugugugcaagagaacucuggucgacaggggcugggguaacggguguggacuauucggcaaaggcagucucgugacaugcgcaaaguuugcuugcucuaagaaaaugaccgggaaguccauucagccugagaaucuggaauaccggaucaugcuuagcguucacggaucgcaacacucugguaugauugugaacgauacgggccaugagaccgacgagaaucgagccaaagucgaaaucacaccaaacucaccccgcgcugaggccacucugggaggguucggcuccuugggucucgauugugaaccuagaaccgggcuggacuuuagugauuuauauuaccugacaaugaauaacaagcacuggcucgugcauaaagagugguuccacgacaucccacuuccguggcacgcaggcgccgauacuggaacaccccauuggaauaacaaggaagcucugguagaguuuaaagacgcgcacgcaaagaggcagaccguuguggucuugggcagccaggagggggccgugcauaccgcucuagccggagcacuggaagccgagauggauggugcuaagggccggcucuccucugggcaccugaaaugccgccuuaagauggacaaacugagauugaagggagucagcuauucacucuguacugccgcauucacguuuacaaaaauuccugcggaaacccugcauggcacugugaccguugaggugcaguacgcugguacagacgggccaugcaagguacccgcccaaauggcagucgauaugcagaccuuaacuccugugggcaggcugauaacagccaacccaguuaucacggaaaguaccgaaaauuccaagaugaugcuagagcucgaucccccguucggagacagcuacauugugaucggcgucggggagaaaaagauaacucaccacuggcaucguucuggaucaacaauugguaaggcuuuugaggccaccgugcggggcgcaaaacgaauggcuguacugggggacacagccugggauuucggaagugugggcggugcgcuuaacagcuuggggaaaggcauccaccagaucuucggagccgcuuuuaagucccuguucggcgggaugucuugguuuucgcaaauucucaucggaacucugcuuauguggcugggcuugaauaccaagaacgguagcauuucccucaugugucuggcauuagggggaguucugauauuccuaucaacggccgucagugcugacgugggcugcucuguggauuuuagcaaaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8388 - RNA, 2365 nt, Artificial Sequence
  KX806557.2 prME-long mRNA Design 3 opt
gggagaaagcuuaccaugagaaucauuaacgccaggaaggagaaaaagcggcgcggcgcugacaccaauguggggauagucggacugcuccuuacaacugcaauggccgcggaaguuacgcgacgugguagcgcuuacuauauguaccuggauagaaacgacgccggcgaggcaaucuccuuccccaccacauuggggaugaauaaaugcuauauucagaucauggauuuaggacacaugugugacgccacuaugucuuacgaaugcccuaugcuggaugagggcguggaaccagacgauguagacuguuggugcaacaccacaucaaccuggguggucuaugguacuugucaucacaagaaaggggaggcuaggcggagucgcagagcagugacacuaccgagccauuccaccaggaagcuccaaacgcggucucagacuuggcuggagucgcgcgaauacaccaagcaccuuauucgaguugagaauuggauguuuagaaaccccggauucgcccuggcugccgcggcaaucgccugguugcucggcucaagcacaagucagaaagugauauaucuggucaugauccugcucauugcuccugccuacuccaucaggugcauuggcgugucuaaucgggauuuuguagaagggaugagcggagguacuuggguugacguggucuuagagcauggcgggugugugaccgugauggcacaggauaagccaacagucgacaucgagcugguuaccacgacuguguccaacauggcugaaguacguucauacugcuaugaggccaguauaagcgauauggcgucugacucccgcugucccacacaaggagaagccuaccuugacaaacagucagauacccaguaugugugcaagagaacuuuggucgacaggggcugggguaauggguguggacuguucggcaaaggcagccuagugacaugcgcaaaguuugcuugcaguaagaaaaugaccgggaagucuauucagccugagaaccucgaauaccggaucaugcuguccguucacggaagccaacacucggguaugauugugaaugauacgggccaugagaccgacgagaaccgagccaaagucgaaaucacaccaaauucuccccgcgcugaggccacucuugggggauucggcucccuggguuuggauugugaaccuagaaccgggcucgacuuuucagaucuguauuacuuaacaaugaacaauaagcacuggcuggugcauaaagagugguuccacgacaucccacucccguggcacgcaggcgccgauacuggaacaccccauuggaacaacaaggaagcucuuguagaguuuaaagacgcgcacgcaaagaggcagaccguugugguccugggcagucaggagggggccgugcauaccgcuuuggccggagcacuagaagccgagauggauggugcuaagggccggcugagcuccgggcaccucaaaugccgccugaagauggacaaacuuagacugaagggagucucuuauagcuuguguacugccgcauucacguuuacaaaaauuccugcggaaacccuccauggcacugugaccguugaggugcaguacgcugguacagacgggccaugcaagguacccgcccaaauggcagucgauaugcagacccugacuccugugggcagguuaauaacagccaauccaguuaucacggaaucaaccgagaacaguaagaugaugcuggagcuagaucccccguucggagacuccuacauugugaucggcgucggggagaaaaagauaacucaccacuggcaucguagcggaucuacaauugguaaggcuuuugaagccaccgugcggggcgcaaaacgaauggcuguacucggggacacagccugggauuucggaucagugggcggugcgcugaauagucuugggaaaggcauccaccagaucuucggagccgcuuuuaagagcuuguucggcgggauguccugguuuucucaaauucugaucggaacucuccugauguggcuuggccugaacaccaagaaugguucgauuagcuugaugugucucgcauuagggggaguucugauauuccuguccacggccgucucagcugacgugggcugcaguguggauuuuucuaaaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8389 - RNA, 2365 nt, Artificial Sequence
  KU870645.1 prME-long mRNA Design 3 opt
gggagaaagcuuaccaugagaaucauuaacgccaggaaggagaaaaagcggcgcggcgcugacaccagcguggggauagucggacugcuccuuacaacugcaauggccgcggaaguuacgcgacgugguuccgcuuacuauauguaccuggauagaaaugacgccggcgaggcaaucucuuuccccaccacauuggggaugaacaaaugcuauauucagaucauggauuuaggacacaugugugacgccacuaugucauacgaaugcccuaugcuggaugagggcguggaaccagacgauguagacuguuggugcaauaccacaaguaccuggguggucuaugguacuugucaucacaagaaaggggaggcuaggcggagccgcagagcagugacacuaccgucccauucuaccaggaagcuccaaacgcggucgcagacuuggcuggagucacgcgaauacaccaagcaccuuauucgaguugagaacuggauccugagaaaucccggauuugccuuggcugccgcggcaauagccuggcuccugggcagcaguacaucccagaaagugaucuaucuggucaugauucucuuaaucgcuccugccuacucuauuaggugcaucggcgugagcaaccgggauuucguagaagggauguccggagguacuuggguugacgugguccuggagcauggcgggugugugaccgugauggcacaggauaagccaacagucgacauagagcuuguuaccacgacugugucaaauauggcugaaguacguaguuacugcuaugaggccagcauuucugauauggcguccgacucacgcugucccacacaaggagaagccuacuuggacaaacagagcgauacccaguaugugugcaagagaacucuggucgacaggggcugggguaacggguguggacuauuuggcaaaggcagucucgugacaugcgcaaaguucgcuugcucuaagaaaaugaccgggaaguccauccagccugagaaucuggaauaccggauuaugcuuagcguucacggaucgcaacacucugguaugaucgugaacgauacgggccaugagaccgacgagaaucgagccaaagucgaaaucacaccaaacucaccccgcgcugaggccacucugggaggguuuggcuccuugggucucgauugugaaccuagaaccgggcuggacuucagugauuuauauuaccugacaaugaauaacaagcacuggcucgugcauaaagagugguuucacgacauuccacuuccguggcacgcaggcgccgauacuggaacaccccauuggaauaacaaggaagcucugguagaguucaaagacgcgcacgcaaagaggcagaccguuguggucuugggcagccaggagggggccgugcauaccgcucuagccggagcacuggaagccgagauggauggugcuaagggccggcucuccucugggcaccugaaaugccgccuuaagauggacaaacugagauugaagggagucagcuauucacucuguacugccgcauuuacguucacaaaaauaccugcggaaacccugcauggcacugugaccguugaggugcaguacgcugguacagacgggccaugcaagguacccgcccaaauggcagucgauaugcagaccuuaacuccugugggcaggcugaucacagccaacccaguuauuacggaaaguaccgaaaauuccaagaugaugcuagagcucgaucccccguuuggagacagcuacaucgugauaggcauuggggagaaaaagaucacucaccacuggcaucguucuggaucaacaaucgguaaggcuuucgaggccaccguccggggcgcaaaacgaauggcugugcugggggacacagccugggauuuuggaaguguaggcggugcgcuuaacagcuuggggaaaggcauucaccagaucuucggagccgcuuucaagucccuguuuggcgggaugucuugguucucgcaaauucucauaggaacucugcuuauguggcugggcuugaauaccaagaacgguagcaucucccucaugugucuggcauuagggggagugcugauuuuucuaucaacggccguuagugcugacgucggcugcucuguggauuucagcaaaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8390 - RNA, 2365 nt, Artificial Sequence
  KU729217.2 prME-long mRNA Design 3 opt
gggagaaagcuuaccaugagaaucauuaacgccaggaaggagaaaaagcggcgcggcgcugacaccagcguggggauagucggacugcuccuuacaacugcaauggccgcggaaguuacgcgacgugguuccgcuuacuauauguaccuggauagaaaugacgccggcgaggcaaucucuuuccccaccacauuggggaugaacaaaugcuauauucagaucauggauuuaggacacaugugugacgccacuaugucauacgaaugcccuaugcuggaugagggcguggaaccagacgauguagacuguuggugcaauaccacaaguaccuggguggucuaugguacuugucaucacaagaaaggggaggcuaggcggagccgcagagcagugacacuaccgucccauucuaccaggaagcuccaaacgcggucgcagacuuggcuggagucacgcgaauacaccaagcaccuuauucgaguugagaacuggaucuuuagaaaucccggauucgcccuggcugccgcggcaauagccugguugcucggcagcaguacaucccagaaagugaucuaucuggucaugauucugcucaucgcuccugccuacucuauuaggugcaucggcgugagcaaccgggauuuuguagaagggauguccggagguacuuggguugacguggucuuagagcauggcgggugugugaccgugauggcacaggauaagccaacagucgacauagagcugguuucaaccacggugaguaauauggcugaaguacguagcuacugcuaugaggccacuauuucugauaucgcguccgacucacgcugucccacacaaggagaagccuaccuugacaaacagagcgauacccaguaugugugcaagagaacuuuggucgacaggggcugggguaacggguguggacuguucggcaaaggcagucuagugacaugcgcaaaguuugcuugcucuaagaaaaugaccgggaaguccauucagccugagaaucucgaauaccggaucaugcugagcguucacggaucgcaacacucugguaugaucgugaacgauacgggccaugagaccgacgagaaucgagccaaagucgaaauuacaccaaacucaccccgcgcugaggccacucuugggggauucggcucccuggguuuggauugugaaccuagaaccgggcucgacuuuagugaucuguauuacuuaacaaugaauaacaagcacuggcuggugcauaaagagugguuccacgacauaccacucccguggcacgcaggcgccgauacuggaacaccccauuggaauaacaaggaagcucuuguagaguuuaaagacgcgcacgcaaagaggcagaccgccguugugcugggcagccaggagggggcuguccauaccgccuuggcaggagcccuagaagcugagauggauggugccaagggccggcuguccucugggcaccucaaaugccgccugaagauggacaaacuuagacugaagggagugagcuauucauuguguacugcagcguucacguuuacaaaaaucccugcugaaacccuccauggcacugucaccguggagguucaguacgccgguacagacgggccaugcaaggugcccgcacaaauggccguagauaugcagacccugacuccugucggcagguuaauuacagcuaacccagugaucacggaaaguaccgaaaauuccaagaugaugcuggagcuagaucccccguucggagacagcuacauaguuauuggcgugggggagaaaaagaucacucaccacuggcaucguucuggaucaacaaucgguaaagccuuugaggcaaccguccggggcgcuaagcgaauggccgugcucggggacacagcgugggauuucggaaguguaggcggugcccugaacagccuugggaaaggcauucaccagaucuucggagcugcauuuaaguccuuguucggcgggaugucuugguuuucgcaaauucugauaggaacucuccugauguggcuuggccugaauaccaagaacgguagcaucuccuugaugugucucgccuuagggggagugcugauuuuccugucaacggcuguuagugccgacgucggcugcucuguggauuuuagcaaaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8391 - RNA, 2365 nt, Artificial Sequence
  KU497555.1 prME-long mRNA Design 3 opt
gggagaaagcuuaccaugagaaucauuaacgccaggaaggagaaaaagcggcgcggcgcugacaccagcguggggauagucggacugcuccuuacaacugcaauggccgcggaaguuacgcgacgugguuccgcuuacuauauguaccuggauagaaaugacgccggcgaggcaaucucuuuccccaccacauuggggaugaacaaaugcuauauucagaucauggauuuaggacacaugugugacgccacuaugucauacgaaugcccuaugcuggaugagggcguggaaccagacgauguagacuguuggugcaauaccacaaguaccuggguggucuaugguacuugucaucacaagaaaggggaggcuaggcggagccgcagagcagugacacuaccgucccauucuaccaggaagcuccaaacgcggucgcagacuuggcuggagucacgcgaauacaccaagcaccuuauucgaguugagaacuggaucuuuagaaaucccggauucgcccuggcugccgcggcaauagccugguugcucggcagcaguacaucccagaaagugaucuaucuggucaugauucugcucaucgcuccugccuacucuauuaggugcaucggcgugagcaaccgggauuuuguagaagggauguccggagguacuuggguugacguggucuuagagcauggcgggugugugaccgugauggcacaggauaagccaacagucgacauagagcugguuaccacgacugugucaaauauggcugaaguacguaguuacugcuaugaggccagcauuucugauauggcguccgacucacgcugucccacacaaggagaagccuaccuugacaaacagagcgauacccaguaugugugcaagagaacuuuggucgacaggggcugggguaacggguguggacuguucggcaaaggcagucuagugacaugcgcaaaguuugcuugcucuaagaaaaugaccgggaaguccauccagccugagaaucucgaauaccggauuaugcugagcguucacggaucgcaacacucugguaugaucgugaacgauacgggccaugagaccgacgagaaucgagccaaagucgaaaucacaccaaacagcccccgcgcugaggccacucuugggggauucggcucacuggguuuggauugugaaccuagaaccgggcucgacuuuagugaucuguauuacuuaacaaugaauaacaagcacuggcuggugcauaaagagugguuccacgacauuccacucccguggcacgcaggcgccgauacuggaacaccccauuggaauaacaaggaagcucuuguagaguuuaaagacgcgcacgcaaagaggcagaccguugugguccugggcacccaggagggggccgugcauacugcuuuggccggagcacuagaagccgagauggauggugcuaagggccggcugagcuccgggcaccucaaaugccgccugaagauggacaaacuuagacugaagggagucucuuauagcuuguguacggccgcauucacauuuaccaaaauaccugcggaaacucuccauggcaccgugacaguugaggugcaguacgcugguaccgacgggccaugcaagguacccgcccaaauggcagucgauaugcagacucugacaccugugggcagguuaaucacggccaacccaguuauuaccgaaucaacugagaauaguaagaugaugcuggagcuagaucccccguucggagacuccuacaucgugauaggcgucggggagaaaaagauuacacaccacuggcaucguagcggaucuaccaucgguaaggcuuuugaagccacagugcggggcgcaaaacgaauggcuguacucggggacacugccugggauuucggaucagugggcggugcgcugaacagucuugggaaaggcauccaccagauuuucggagccgcuuuuaagagcuuguucggcgggauguccugguuuucucaaauccugauuggaacccuccugauguggcuuggccugaauacgaagaacgguucgauauccuugaugugucucgcauuagggggaguucugaucuuccuguccaccgccgucucagcugacgugggcugcaguguggauuuuucuaaaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8392 - RNA, 2365 nt, Artificial Sequence
  KX087101.3 prME-long mRNA Design 3 opt
gggagaaagcuuaccaugagaaucauuaacgccaggaaggagaaaaagcggcgcggcgcugacaccagcguggggauagucggacugcuccuuacaacugcaauggccgcggaaguuacgcgacgugguuccgcuuacuauauguaccuggauagaaaugacgccggcgaggcaaucucuuuccccaccacauuggggaugaacaaaugcuauauucagaucauggauuuaggacacaugugugacgccacuaugucauacgaaugcccuaugcuggaugagggcguggaaccagacgauguagacuguuggugcaauaccacaaguaccuggguggucuaugguacuugucaucacaagaaaggggaggcuaggcggagccgcagagcagugacacuaccgucccauucuaccaggaagcuccaaacgcggucgcagacuuggcuggagucacgcgaauacaccaagcaccuuauucgaguugagaacuggaucuuuagaaaucccggauucgcccuggcugccgcggcaauagccugguugcucggcagcaguacaucccagaaagugaucuaucuggucaugauucugcucaucgcuccugccuacucuauuaggugcaucggcgugagcaaccgggauuuuguagaagggauguccggagguacuuggguugacguggucuuagagcauggcgggugugugaccgugauggcacaggauaagccaacagucgacauagagcugguuaccacgacugugucaaauauggcugaaguacguaguuacugcuaugaggccagcauuucugauauggcguccgacucacgcugucccacacaaggagaagccuaccuugacaaacagagcgauacccaguaugugugcaagagaacuuuggucgacaggggcugggguaacggguguggacuguucggcaaaggcagucuagugacaugcgcaaaguuugcuugcucuaagaaaaugaccgggaaguccauccagccugagaaucucgaauaccggauuaugcugagcguucacggaucgcaacacucugguaugaucgugaacgauacgggccaugagaccgacgagaaucgagccaaagucgaaaucacaccaaacucaccccgcgcugaggccacucuugggggauucggcucccuggguuuggauugugaaccuagaaccgggcucgacuuuagugaucuguauuacuuaacaaugaauaacaagcacuggcuggugcauaaagagugguuccacgacauuccacucccguggcacgcaggcgccgauacuggaacaccccauuggaauaacaaggaagcucuuguagaguuuaaagacgcgcacgcaaagaggcagaccguugugguccugggcagccaggagggggccgugcauaccgcuuuggccggagcacuagaagccgagauggauggugcuaagggccggcuguccucugggcaccucaaaugccgccugaagauggacaaacuuagacugaagggagucagcuauucauuguguacugccgcauucacguuuacaaaaauaccugcggaaacccuccauggcacugugaccguugagcugcaguacgcugguacagacgggccaugcaaggugcccgcccaaauggcaguagauaugcagaccuuaacuccugucggcaggcugaucacagccaacccagugauuacggaaaguaccgaaaauuccaagaugaugcuagagcucgaucccccguucggagacagcuacaucguuauaggcgugggggagaaaaagauuacucaccacuggcaucguucuggaucaacaaucgguaaggcuuuugaggccaccguccggggcgcaaaacgaauggcugugcugggggacacagccugggauuucggaaguguaggcggugcgcuuaacagcuuggggaaaggcauccaccagauuuucggagccgcuuuuaagucccuguucggcgggaugucuugguuuucgcaaauccucauuggaacucugcuuauguggcugggcuugaauaccaagaacgguagcauaucccucaugugucuggcauuagggggagugcugaucuuccuaucaacggccguuagugcugacgucggcugcucuguggauuuuagcaaaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8393 - RNA, 2365 nt, Artificial Sequence
  KY075932.1 prME-long mRNA Design 3 opt
gggagaaagcuuaccaugagaaucauuaacgccaggaaggagaaaaagcggcgcggcgcugaaaccagcguggggauagucggacugcuccuuacaacugcaauggccgcggagguuacgcgacgugguuccgcuuacuauauguaccuggacagaaaugaugccggcgaagcaaucucuuuccccaccacauuggggaugaacaaaugcuauauucagaucauggacuuaggacacaugugugaugccacuaugucauacgagugcccuaugcuggacgaaggcguggagccagaugacguagauuguuggugcaauaccacaaguaccuggguggucuaugguacuugucaucacaagaaaggggaggcuaggcggagccgcagagcagugacacuaccgucccauucuaccaggaagcuccaaacgcggucgcagacuuggcuggaaucacgcgaguacaccaagcaccuuauucgaaucgaaaacuggauauuuagaaaucccggauucgcccuggcugccgcggcaaucgccugguugcucggcagcaguacaucccagaaaguuauuuaucuggugaugauccugcucauugcuccugccuacucuaucaggugcauaggcgucagcaaccgggacuuuguggaggggauguccggagguacuuggguagauguuguguuagagcauggcgggugugucaccgugauggcacaggacaagccaacaguggauauugaacuggucaccacgacuguuucaaauauggcugaggugcguaguuacugcuaugaagccagcaucucugacauggcguccgauucacgcugucccacacaaggagaggccuaccuugacaaacagagcgacacccaguauguaugcaagagaacuuugguggauaggggcugggguaacggguguggacuguucggcaaaggcagucuagucacaugcgcaaaguuugcuugcucuaagaaaaugaccgggaaguccauucagccugaaaaucucgaguaccggaucaugcugagcgugcacggaucgcaacacucugguaugaucguuaacgacacgggccaugagaccgaugaaaaucgagccaaaguggagauuacaccaaacucaccccgcgcugaagccacucuugggggauucggcucccuggguuuggacugugagccuagaaccgggcucgauuuuagugaccuguauuacuuaacaaugaauaacaagcacuggcugguccauaaagaaugguuccacgauauaccacucccguggcacgcaggcgccgacacuggaacaccccauuggaauaacaaggaggcucuuguggaguuuaaagaugcgcacgcaaagaggcagaccguaguugugcugggcagccaggaaggggccguccauaccgcuuuggccggagcacuagaggccgaaauggacggugcuaagggccggcuguccucugggcaccucaaaugccgccugaagauggauaaacuuagacugaagggagugagcuauucauuguguacugccgcauucacguuuacaaaaaucccugcggagacccuccauggcacugucaccguggaaguucaguacgcugguacagacgggccaugcaaggugcccgcccaaauggcaguagacaugcagacccugacuccugucggcagguuaauuacagccaacccagugaucacggagaguaccgaaaauuccaagaugaugcuggagcuagaucccccguucggagacagcuacauaguuauuggcgugggggagaaaaagaucacucaccacuggcaucguucuggaucaacaaucgguaaggcuuuugaagccaccguccggggcgcaaaacgaauggcugugcucggggauacagccugggacuucggaaguguaggcggugcgcugaacagccuugggaaaggcauucaccagaucuucggagccgcuuuuaaguccuuguucggcgggaugucuugguuuucgcaaauucugauaggaacucuccugauguggcuuggccugaauaccaagaacgguagcaucuccuugaugugucucgcauuagggggagugcugauuuuccugucaacggccguuagugcugaugucggcugcucuguggacuuuagcaaaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8394 - RNA, 2365 nt, Artificial Sequence
  KY014317.1 prME-long mRNA Design 3 opt
gggagaaagcuuaccaugagaaucauuaacgccaggaaggagaaaaagcggcgcggcgcugacaccagcguggggauagucggacugcuccuuacaacugcaauggccgcggaaguuacgcgacgugguuccgcuuacuauauguaccuggauagaaaugacgccggcgaggcaaucucuuuccccaccacauuggggaugaacaaaugcuauauucagaucauggauuuaggacacaugugugacgccacuaugucauacgaaugcccuaugcuggaugagggcguggaaccagacgauguagacuguuggugcaauaccacaaguaccuggguggucuaugguacuugucaucacaagaaaggggaggcuaggcggagccgcagagcagugacacuaccgucccauucuaccaggaagcuccaaacgcggucgcagacuuggcuggagucacgcgaauacaccaagcaccuuauucgaguugagaacuggaucuuuagaaaucccggauucgcccuggcugccgcggcaauagccugguugcucggcagcaguacaucccagaaagugaucuaucuggucaugauucugcucaucgcuccugccuacucuauuaggugcaucggcgugagcaaccgggauuuuguagaagggauguccggagguacuuggguugacguggucuuagagcauggcgggugugugaccgugauggcacaggauaagccaacagucgacauagagcugguuaccacgacugugucaaauauggcugaaguacguaguuacugcuaugaggccagcauuucugauauggcguccgacucacgcugucccacacaaggagaagccuaccuugacaaacagagcgauacccaguaugugugcaagagaacuuuggucgacaggggcugggguaacggguguggacuguucggcaaaggcagucuagugacaugcgcaaaguuugcuugcucuaagaaaaugaccgggaaguccauccagccugagaaucucgaauaccggauuaugcugagcguucacggaucgcaacacucugguaugaucgugaacgauacgggccaugagaccgacgagaaucgagccaaagucgaaaucacaccaaacucaccccgcgcugaggccacucuugggggauucggcucccuggguuuggauugugaaccuagaaccgggcucgacuuuagugaucuguauuacuuaacaaugaauaacaagcacuggcuggugcauaaagagugguuccacgacauuccacucccguggcacgcaggcgccgauacuggaacaccccauuggaauaacaaggaagcucuuguagaguuuaaagacgcgcacgcaaagaggcagaccguugugguccugggcagccaggagggggccgugcauaccgcuuuggccggagcacuagaagccgagauggauggugcuaagggccggcuguccucugggcaccucaaaugccgccugaagauggacaaacuuagacugaagggagucagcuauucauuguguacugccgcauucacguuuacaaaaauaccugcggaaacccuccauggcacugugaccguugaggugcaguacgcugguacagacgggccaugcaagguacccgcccaaauggcagucgauaugcagacccugacuccugugggcagguuaaucacagccaacccaguuauuacggaaaguaucgaaaauuccaagaugaugcuggagcuagaucccccguucggagacagcuacauagugauuggcgucggggagaaaaagaucacccaccacuggcaucguucuggaucaacuaucgguaaggcuuuugaggccacagugcggggcgcaaaacgaauggcuguacucggggacaccgccugggauuucggaagugugggcggugcgcugaacagccuugggaaaggcauucaccagaucuucggagccgcuuuuaaguccuuguucggcgggaugucuugguuuucgcaaauucugauaggaacacuccugauguggcuuggccugaauacuaagaacgguagcaucuccuugaugugucucgcauuagggggaguucugauuuuccugucaaccgccgucagugcugacgugggcugcucuguggauuuuagcaaaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8395 - RNA, 2365 nt, Artificial Sequence
  KU758876.1 prME-long mRNA Design 3 opt
gggagaaagcuuaccaugagaaucauuaacgccaggaaggagaaaaagcggcgcggcgcugacaccagcguggggauagucggacugcuccuuacaacugcaauggccgcggaaguuacgcgacgugguuccgcuuacuauauguaccuggauagaaaugacgccggcgaggcaaucucuuuccccaccacauuggggaugaacaaaugcuauauucagaucauggauuuaggacacaugugugacgccacuaugucauacgaaugcccuaugcuggaugagggcguggaaccagacgauguagacuguuggugcaauaccacaaguaccuggguggucuaugguacuugucaucacaagaaaggggaggcuaggcggagccgcagagcagugacacuaccgucccauucuaccaggaagcuccaaacgcggucgcagacuuggcuggagucacgcgaauacaccaagcaccuuauucgaguugagaacuggaucuuuagaaaucccggauucgcccuggcugccgcggcaauagccugguugcucggcagcaguacaucccagaaagugaucuaucuggucaugauucugcucaucgcuccugccuacucuauuaggugcaucggcgugagcaaccgggauuuuguagaagggauguccggagguacuuggguugacguggucuuagagcauggcgggugugugaccgugauggcacaggauaagccaacagucgacauagagcugguuaccacgacugugucaaauauggcugaaguacguaguuacugcuaugaggccagcauuucugauauggcguccgacucacgcugucccacacaaggagaagccuaccuugacaaacagagcgauacccaguaugugugcaagagaacuuuggucgacaggggcugggguaacggguguggacuguucggcaaaggcagucuagugacaugcgcaaaguuugcuugcucuaagaaaaugaccgggaaguccauccagccugagaaucucgaauaccggauuaugcugagcguucacggaucgcaacacucugguaugaucgugaacgauacgggccaugagaccgacgagaaucgagccaaagucgaaaucacaccaaacucaccccgcgcugaggccacucuugggggauucggcucccuggguuuggauugugaaccuagaaccgggcucgacuuuagugaucuguauuacuuaacaaugaauaacaagcacuggcuggugcauaaagagugguuccacgacauuccacucccguggcacgcaggcgccgauacuggaacaccccauuggaauaacaaggaagcucuuguagaguuuaaagacgcgcacgcaaagaggcagaccguugugguccugggcagccaggagggggccgugcauaccgcuuuggccggagcacuagaagccgagauggauggugucaagggccggcuguccucugggcaccucaaaugccgccugaagauggacaaacuuagacugaagggagugagcuauucauuguguacugcugccuucacguuuacaaaaauaccugcagaaacccuccauggcacuguuaccguggagguacaguacgcggguacagacgggccaugcaagguccccgcucaaauggccguggauaugcagacccugacuccuguuggcagguuaaucacagcaaacccagugauuacggaaaguaccgaaaauuccaagaugaugcuggagcuagaucccccguucggagacagcuacaucgucauaggcgugggggagaaaaagauuacucaccacuggcaucguucuggaucaacaaucgguaaagccuuugaggcuaccguacggggcgccaagcgaauggcagugcucggggacacagcuugggauuucggaaguguuggcggugcccugaacagccuugggaaaggcauccaccagauuuucggagcggccuuuaaguccuuguucggcgggaugucuugguuuucgcaaauccugauuggaacucuccugauguggcuuggccugaauaccaagaacgguagcauauccuucauguguuuggcucucgggggaguccugaucuuuuuaucaacggcagugagugccgacgugggcugcucugucgauuucagcaaaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8396 - RNA, 2365 nt, Artificial Sequence
  KU758874.1 prME-long mRNA Design 3 opt
gggagaaagcuuaccaugagaaucauuaacgccaggaaggagaaaaagcggcgcggcgcugacaccagcguggggauagucggacugcuccuuacaacugcaauggccgcggaaguuacgcgacgugguuccgcuuacuauauguaccuggauagaaaugacgccggcgaggcaaucucuuuccccaccacauuggggaugaacaaaugcuauauucagaucauggauuuaggacacaugugugacgccacuaugucauacgaaugcccuaugcuggaugagggcguggaaccagacgauguagacuguuggugcaauaccacaaguaccuggguggucuaugguacuugucaucacaagaaaggggaggcuaggcggagccgcagagcagugacacuaccgucccauucuaccaggaagcuccaaacgcggucgcagacuuggcuggagucacgcgaauacaccaagcaccuuauucgaguugagaacuggaucuuuagaaaucccggauucgcccuggcugccgcggcaauagccugguugcucggcagcaguacaucccagaaagugaucuaucuggucaugauucugcucaucgcuccugccuacucuauuaggugcaucggcgugagcaaccgggauuuuguagaagggauguccggagguacuuggguugacguggucuuagagcauggcgggugugugaccgugauggcacaggauaagccaacagucgacauagagcugguuaccacgacugugucaaauauggcugaaguacguaguuacugcuaugaggccagcauuucugauauggcguccgacucacgcugucccacacaaggagaagccuaccuugacaaacagagcgauacccaguaugugugcaagagaacuuuggucgacaggggcugggguaacggguguggacuguucggcaaaggcagucuagugacaugcgcaaaguuugcuugcucuaagaaaaugaccgggaaguccauccagccugagaaucucgaauaccggauuaugcugagcguucacggaucgcaacacucugguaugaucgugaacgauacgggccaugagaccgacgagaaucgagccaaagucgaaaucacaccaaacucaccccgcgcugaggccacucuugggggauucggcucccuggguuuggauugugaaccuagaaccgggcucgacuuuagugaucuguauuacuuaacaaugaauaacaagcacuggcuggugcauaaagagugguuccacgacauuccacucccguggcacgcaggcgccgauacuggaacaccccauuggaauaacaaggaagcucuuguagaguuuaaagacgcgcacgcaaagaggcagaccguugugguccugggcagccaggagggggccgugcauaccgcuuuggccggagcacuagaagccgagauggauggugcuaagggcaaacuguccucugggcaccucaagugccggcugaaaauggacaagcugcgccugaaaggagucagcuauucauuguguacugccgcauucacguuuacaaagauaccugcggaaacccuccauggcacugugaccguugaggugcaguacgcugguacagacgggccaugcaagguacccgcccaaauggcagucgauaugcagacccugacuccugugggcagauuaaucacagccaacccaguuauuacggaaaguaccgaaaauuccaaaaugaugcuggagcuagaucccccguucggagacagcuacaucgugauaggcgucggggagaagaaaauuacucaccacuggcauaggucuggaucaacaaucgguaaggcuuuugaggccaccgugcguggcgcaaaacggauggcuguacucggggacacagccugggauuucggaagugugggcggugcgcugaacagccuugggaagggcauccaccagauuuucggagccgcuuuuaaguccuuguucggcgggaugucuugguuuucgcaaauccugauuggaacucuccugauguggcuuggccugaauaccaaaaacgguagcauauccuugaugugucucgcacuugggggaguuuuaaucuuccugucaacggccgucagugcugacgugggcugcucuguggauuuuagcaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8397 - RNA, 2365 nt, Artificial Sequence
  KY014314.1 prME-long mRNA Design 3 opt
gggagaaagcuuaccaugagaaucauuaacgccaggaaggagaaaaagcggcgcggcgcugacaccagcguggggauagucggacugcuccuuacaacugcaauggccgcggaaguuacgcgacgugguuccgcuuacuauauguaccuggauagaaaugacgccggcgaggcaaucucuuuccccaccacauuggggaugaacaaaugcuauauucagaucauggauuuaggacacaugugugacgccacuaugucauacgaaugcccuaugcuggaugagggcguggaaccagacgauguagacuguuggugcaauaccacaaguaccuggguggucuaugguacuugucaucacaagaaaggggaggcuaggcggagccgcagagcagugacacuaccgucccauucuaccaggaagcuccaaacgcggucgcagacuuggcuggagucacgcgaauacaccaagcaccuuauucgaguugagaacuggaucuuuagaaaucccggauucgcccuggcugccgcggcaauagccugguugcucggcagcaguacaucccagaaagugaucuaucuggucaugauucugcucaucgcuccugccuacucuauuaggugcaucggcgugagcaaccgggauuuuguagaagggauguccggagguacuuggguugacguggucuuagagcauggcgggugugugaccgugauggcacaggauaagccaacagucgacauagagcugguuaccacgacugugucaaauauggcugaaguacguaguuacugcuaugaggccagcauuucugauauggcguccgacucacgcugucccacacaaggagaagccuaccuugacaaacagagcgauacccaguaugugugcaagagaacuuuggucgacaggggcugggguaacggguguggacuguucggcaaaggcagucuagugacaugcgcaaaguuugcuugcucuaagaaaaugaccgggaaguccauccagccugagaaucucgaauaccggauuaugcugagcguucacggaucgcaacacucugguaugaucgugaacgauacgggccaugagaccgacgagaaucgagccaaagucgaaaucacaccaaacucaccccgcgcugaggccacucuugggggauucggcucccuggguuuggauugugaaccuagaaccgggcucgacuuuagugaucuguauuacuuaacaaugaauaacaagcacuggcuggugcauaaagagugguuccacgacauuccacucccguggcacgcaggcgccgauacuggaacaccccauuggaauaacaaggaagcucuuguagaguuuaaagaggcgcacgcaaagaggcagaccguugugguccugggcagccaggaaggggccgugcauaccgcuuuggccggagcacuagaggccgaaauggacggugcuaagggccggcuguccucugggcaccucaaaugccgccugaagauggauaaacuuagacugaagggagucagcuauucauuguguacugccgcauucacguuuacaaaaauaccugcggagacccuccauggcacugugaccguugaagugcaguacgcugguacagacgggccaugcaagguacccgcccaaauggcagucgacaugcagacccugacuccugugggcagguuaaucacagccaacccaguuauuacggagaguaccgaaaauuccaagaugaugcuggagcuagaucccccguucggagacagcuacaucgugauaggcgucggggagaaaaagauuacucaccacuggcaucguucuggaucaacaaucgguaaggcuuuugaagccaccgugcggggcgcaaaacgaauggcuguacucggggauacagccugggacuucggaagugugggcggugcgcugaacagccuugggaaaggcauccaccagauuuucggagccgcuuuuaaguccuuguucggcgggaugucuugguuuucgcaaauccugauuggaacucuccugauguggcuuggccugaauaccaagaacgguagcauauccuugaugugucucgcauuagggggaguucugaucuuccugucaacggccgucagugcugaugugggcugcucuguggacuuuagcaaaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8398 - RNA, 2365 nt, Artificial Sequence
  KU926310.1 prME-long mRNA Design 3 opt
gggagaaagcuuaccaugagaaucauuaacgccaggaaggagaaaaagcggcgcggcgcugacaccagcguggggauagucggacugcuccuuacaacugcaauggccgcggaaguuacgcgacgugguuccgcuuacuauauguaccuggauagaaaugacgccggcgaggcaaucucuuuccccaccacauuggggaugaacaaaugcuauauucagaucauggauuuaggacacaugugugacgccacuaugucauacgaaugcccuaugcuggaugagggcguggaaccagacgauguagacuguuggugcaauaccacaaguaccuggguggucuaugguacuugucaucacaagaaaggggaggcuaggcggagccgcagagcagugacacuaccgucccauucuaccaggaagcuccaaacgcggucgcagacuuggcuggagucacgcgaauacaccaagcaccuuauucgaguugagaacuggaucuuuagaaaucccggauucgcccuggcugccgcggcaauagccugguugcucggcagcaguacaucccagaaagugaucuaucuggucaugauucugcucaucgcuccugccuacucuauuaggugcaucggcgugagcaaccgggauuuuguagaagggauguccggagguacuuggguugacguggucuuagagcauggcgggugugugaccgugauggcacaggauaagccaacagucgacauagagcugguuaccacgacugugucaaauauggcugaaguacguaguuacugcuaugaggccagcauuucugauauggcguccgacucacgcugucccacacaaggagaagccuaccuugacaaacagagcgauacccaguaugugugcaagagaacuuuggucgacaggggcugggguaacggguguggacuguucggcaaaggcagucuagugacaugcgcaaaguuugcuugcucuaagaaaaugaccgggaaguccauccagccugagaaucucgaauaccggauuaugcugagcguucacggaucgcaacacucugguaugaucgugaacgauacgggccaugagaccgacgagaaucgagccaaagucgaaaucacaccaaacucaccccgcgcugaggccacucuugggggauucggcucccuggguuuggauugugaaccuagaaccgggcucgacuuuagugaucuguauuacuuaacaaugaauaacaagcacuggcuggugcauaaagagugguuccacgacauuccacucccguggcacgcaggcgccgauacuggaacaccccauuggaauaacaaggaagcucuuguagaguuuaaagacgcgcacgcaaagaggcagaccguugugguccugggcagccaggagggggccgugcauaccgcuuuggccggagcacuagaagccgagauggauggugcuaagggccggcuguccucugggcaccucaaaugccgccugaagauggacaaacuuagacugaagggagucagcuauucauuguguacugccgcauucacguuuacaaaaauaccugcggaaacccuccauggcacugugaccguugaggugcaguacgcuggugccgacgggccaugcaagguacccgcacaaauggccgucgauaugcagacacugaccccugugggcagguuaaucacugcuaacccaguuauuacagaaaguacggaaaauuccaagaugaugcuggagcuagaucccccguucggagacagcuacaucgugauaggcgucggggagaaaaagauuacccaccacuggcaucguucuggaucaacuaucgguaaagccuuugaggcaacagugcggggcgcuaagcgaauggccguacucggggacaccgcgugggauuucggaagugugggcggugcccugaacagccuugggaaaggcauccaccagauuuucggagcugcauuuaaguccuuguucggcgggaugucuugguuuucgcaaauccugauuggaacacuccugauguggcuuggccugaauacuaagaacgguagcauauccuugaugugucucgccuuagggggaguucugaucuuccugucaaccgcugucagugccgacgugggcugcucuguggauuuuagcaaaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8399 - RNA, 2365 nt, Artificial Sequence
  KU761560.1 prME-long mRNA Design 3 opt
gggagaaagcuuaccaugagaaucauuaacgccggcaaggagaaaaagaggcgcggggcugacaccaaugugggaauagucggucugcuccuuacaacugcaauggccgcggaaguuacgcggcgaggcagcgcuuacuauauguaccuggaucguaacgacgccggggaggcaaucuccuuccccaccacauugggaaugaauaaaugcuauauucagaucauggauuuaggccacaugugugacgccacuaugucuuacgaaugcccuaugcuggaugaggguguggaaccagacgauguagacuguuggugcaacaccacaucaaccuggguggucuaugggacuugucaucacaagaaaggagaggcuagaaggagucggcgcgcagugacacuaccgagccauuccaccagaaagcuccaaacgaggucucagacuuggcuggagucgcgggaauacaccaagcaccuuauucgcguugagaauuggaucuuucgaaaccccggcuucgcccuggcugccgcggcaauagccugguugcucggcucaagcacaagucagaaagugaucuaucuggucaugauucugcucaucgcuccugccuacuccauuagaugcaucggggugucuaauagggauuuuguagaaggaaugagcgguggcacuuggguugacguggucuuagagcaugggggaugugugaccgugauggcacaggauaagccaacagucgacauagagcugguuaccacgacuguguccaacauggcugaaguacggucauacugcuaugaggccaguauuagcgauauggcgucugacucccguugucccacacaaggcgaagccuaccuugacaaacagucagauacccaguaugugugcaagcgcacuuuggucgacagagguugggggaauggauguggccuguucggcaaagggagccuagugacaugcgcaaaguuugcuugcaguaagaaaaugaccggaaagucuauccagccugagaaccucgaauacaggauuaugcuguccguucacgguagccaacacucgggcaugaucgugaaugauacggggcaugagaccgacgagaaccgggccaaagucgaaaucacaccaaauucuccccgagcugaggccacucuuggaggcuucgguucccugggguuggauugugaaccucgcaccggccucgacuuuucagaucuguauuacuuaacaaugaacaauaagcacuggcuggugcauaaagagugguuccacgacauuccacucccguggcacgcaggagccgauacuggcacaccccauuggaacaacaaggaagcucuuguagaguuuaaagacgcgcacgcaaagagacagaccguugugguccuggggagucaggagggagccgugcauaccgcuuuggccggugcacuagaagccgagauggauggcgcuaaggggaggcugagcuccggacaccucaaaugccggcugaagauggacaaacuucgccugaagggcgucucuuauagcuuguguacugccgcauucacguuuacaaaaauaccugcggaaacccuccaugguacugugaccguugaggugcaguacgcugggacagacggcccaugcaagguacccgcccaaauggcagucgauaugcagacccugacuccugugggaagauuaaucacagccaauccaguuauuacggaaucaaccgagaacaguaagaugaugcuggagcuagaucccccguucggcgacuccuacaucgugauaggggucggagagaaaaagauuacucaccacuggcauaggagcgguucuacaaucggcaaggcuuuugaagccaccgugcguggggcacggcgaauggcuguacucggagacacagccugggauuucggcucaguggguggggcgcugaauagucuuggcaaaggaauccaccagauuuucggcgccgcuuuuaagagcuuguucgggggaauguccugguuuucucaaauccugauuggcacucuccugauguggcuuggucugaacaccaaaaaugggucgaucagcuugaugugucucgcacugggaggcguuuuaauauuccuguccacggccgucucagcugacguggguugcaguguggauuuuucuaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8400 - RNA, 2365 nt, Artificial Sequence
  KY317939.1 prME-long mRNA Design 3 opt
gggagaaagcuuaccaugagaaucauuaacgccaggaaggagaaaaagcggcgcggcgcugaaaccagcguggggauagucggacugcuccuuacaacugcaauggccgcggagguuacgcgacgugguuccgcuuacuauauguaccuggacagaaaagaugccggcgaagcaaucucuuuccccaccacauuggggaugaauaagugcuauauucagaucauggacuuaggacacaugugugaugccacuaugucauacgagugcccuaugcuggacgaaggcguggagccagaugacguagauuguuggugcaacaccacaaguaccuggguggucuaugguacuugucaucacaaaaagggggaggcuaggcggagccgcagagcagugacacuaccgucccauucuaccaggaagcuccaaacgcggucgcagacuuggcuggaaucacgcgaguacaccaaacaccuuauucgaguugaaaauuggaucuuuagaaaccccggauucgcccuggcugccgcggcaauagccugguugcucggcagcaguacaucccagaaggugaucuaucuggucaugauucugcucaucgcuccugccuacucuauuaggugcaucggcgugagcaaucgggacuuuguagaggggauguccggagguacuuggguugauguggucuuagagcauggcgggugugugaccgugauggcacaggacaaaccaacagucgauauagaacugguuaccacgacugugucaaacauggcugagguacguaguuacugcuaugaagccagcauuucugacauggcguccgauucacgcugucccacacaaggagaggccuaccuugacaagcagagcgacacccaguaugugugcaaaagaacuuuggucgauaggggcugggguaauggguguggacuguucggcaagggcagucuagugacaugcgcaaaguuugcuugcucuaaaaagaugaccgggaaauccauccagccugaaaaccucgaguaccggauuaugcugagcguucacggaucgcaacacucugguaugaucgugaaugacacgggccaugagaccgaugaaaaccgagccaaggucgagaucacaccaaauucaccccgcgcugaagccacucuugggggauucggcucccuggguuuggacugugagccuagaaccgggcucgauuuuagugaccuguauuacuuaacaaugaacaauaaacacuggcuggugcauaaggaaugguuccacgauauuccacucccguggcacgcaggcgccgacacuggaacaccccauuggaacaauaaagaggcucuuguagaguuuaaggaugcgcacgcaaagaggcagaccguugugguccugggcagccaggaaggggccgugcauaccgcuuuggccggagcacuagaggccgaaauggacggugcuaaaggccggcuguccucugggcaccucaagugccgccugaaaauggauaagcugagacugaaaggagucagcuauucauuguguacugccgcauucacguuuacaaagauaccugcggagacccuccauggcacugugaccguugaagugcaguacgcugguacagacgggccaugcaagguacccgcccaaauggcagucgacaugcagacccugacuccugugggcagguuaaucacagccaacccaguuauuacggagaguaccgagaacuccaaaaugaugcuggaacuagaucccccguucggagacagcuacaucgugauaggcgucggggagaagaaaauuacucaccacuggcaucguucuggaucaacaaucgguaaggcuuuugaagccaccgugcggggcgcaaaacgaauggcuguacucggggauacagccugggacuucggaagugugggcggugcgcugaauagccuugggaagggcauccaccagauuuucggagccgcuuuuaaguccuuguucggcgggaugucuugguuuucgcaaauccugauuggaacucuccugauguggcuuggccugaacaccaaaaaugguagcauauccuugaugugucucgcacuugggggaguuuuaaucuuccugucaacggccgucagugcugaugugggcugcucuguggacuuuagcaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8401 - RNA, 2365 nt, Artificial Sequence
  KY075937.1 prME-long mRNA Design 3 opt
gggagaaagcuuaccaugagaaucauuaacgccaggaaggagaaaaagcggcgcggcgcugacaccagcguggggauagucggacugcuccuuacaacugcaauggccgcggaaguuacgcgacgugguuccgcuuacuauauguaccuggauagaaaugacgccggcgaggcaaucucuuuccccaccacauuggggaugaacaaaugcuauauucagaucauggauuuaggacacaugugugacgccacuaugucauacgaaugcccuaugcuggaugagggcguggaaccagacgauguagacuguuggugcaauaccacaaguaccuggguggucuaugguacuugucaucacaagaaaggggaggcuaggcggagccgcagagcagugacacuaccgucccauucuaccaggaagcuccaaacgcggucgcagacuuggcuggagucacgcgaauacaccaagcaccuuauucgaguugagaacuggaucuuuagaaaucccggauucgcccuggcugccgcggcaauagccugguugcucggcagcaguacaucccagaaagugaucuaucuggucaugauucugcucaucgcuccugccuacucuauuaggugcaucggcgugagcaaccgggauuuuguagaagggauguccggagguacuuggguugacguggucuuagagcauggcgggugugugaccgugauggcacaggauaagccaacagucgacauagagcugguuaccacgacugugucaaauauggcugaaguacguaguuacugcuaugaggccagcauuucugauaugguguccgacucacgcugucccacacaaggagaagcguaccuugacaaacagagcgauacccaguaugucugcaagagaacuuugguggacaggggcugggguaacggguguggacuguucggcaaaggcagucuaguuacaugcgccaaguuugcaugcucuaagaaaaugaccgggaaguccauccagccugagaaucucgaauaccggauuaugcugagcgugcacggaucgcaacacucugguaugaucgucaacgauacgggccaugagaccgacgagaaucgagcuaaaguggaaaucacaccaaacucaccccgcgccgaggcuacucuugggggauucggcucccuggguuuggauugugaaccuagaaccgggcucgacuuuagugaucuguauuacuuaacaaugaauaacaagcacuggcugguacauaaagagugguuccacgacauuccacucccguggcacgccggcgcagauacuggaacaccccauuggaauaacaaggaagcccuuguugaguuuaaagacgcucacgcgaagaggcagaccguggucgugcugggcagccaggagggggcaguccauaccgccuuggcuggagcccuagaagcagagauggauggugccaagggccggcuguccucugggcaccucaaaugccgccugaagauggacaaacuuagacugaagggagugagcuauucauuguguacugcugccuucacguuuacaaaaauaccugcagaaacccuccauggcacuguuaccguggagguacaguacgcggguacagacgggccaugcaagguccccgcucaaauggccguggauaugcagacccugacuccuguuggcagguuaaucacagcaaacccagugauuacggaaaguaccgaaaauuccaagaugaugcuggagcuagaucccccguucggagacagcuacaucgucauaggcgugggggagaaaaagauuacucaccacuggcaucguucuggaucaacaaucgguaaagccuuugaggcuaccguacggggcgccaagcgaauggcagugcucggggacacagcuugggauuucggaaguguuggcggugcccugaacagccuugggaaaggcauccaccagauuuucggagcggccuuuaaguccuuguucggcgggaugucuugguuuucgcaaauccugauuggaacucuccugauguggcuuggccugaauaccaagaacgguagcauauccuugaugugucucgcuuuagggggaguccugaucuuccugucaacggcagugagugccgacgugggcugcucugucgauuuuagcaaaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8402 - RNA, 2365 nt, Artificial Sequence
  LC191864.1 prME-long mRNA Design 3 opt
gggagaaagcuuaccaugagaaucauuaacgccaggaaggagaaaaagcggcgcggcgcugacaccaauguggggauagucggacugcuccuuacaacugcaauggccgcggaaguuacgcgacgugguagcgcuuacuauauguaccuggauagaaacgacgccggcgaggcaaucuccuuccccaccacauuggggaugaauaaaugcuauauucagaucauggauuuaggacacaugugugacgccacuaugucuuacgaaugcccuaugcuggaugagggcguggaaccagacgauguagacuguuggugcaacaugaccucaacauggguggucuaugguaccugucaucacaagaaaggggaggcuaggcggagucgcagagcagugacucuaccgagccauuccacaaggaagcuccaaacccggucucagacguggcuggagucgcgcgaauacacuaagcaccuuauucgaguugagaauuggaucuuuagaaaccccggauucgcccuggcugccgcggcaauagccugguugcucggcucaagcaccagucagaaagugaucuaucuggucaugauucugcucaucgcuccugccuacuccauuaggugcaucggcgugucuaaucgggauuuuguagaagggaugagcggagguacauggguugacguggucuuagagcauggcgggugugugacugugauggcacaggauaagccaaccgucgacauagagcugguuacaaccacgguguccaacauggcugaaguacguucauacugcuaugaggccaguauuagcgauauggcgucugacucccgcugucccacucaaggagaagccuaccuugacaaacagucagauacacaguaugugugcaagagaaccuuggucgacaggggcugggguaauggguguggacuguucggcaaaggcagccuagugacuugcgcaaaguuugcuugcaguaagaaaaugacagggaagucuauccagccugagaaccucgaauaccggauuaugcuguccguucacggaagccaacacucggguaugaucgugaaugauaccggccaugagacggacgagaaccgagccaaagucgaaaucaccccaaauucuccccgcgcugaggccacacuugggggauucggcucccuggguuuggauugugaaccuagaacugggcucgacuuuucagaucuguauuacuuaaccaugaacaauaagcacuggcuggugcauaaagagugguuccacgacauuccacucccguggcacgcaggcgccgauacaggaacuccccauuggaacaacaaggaagcucuuguagaguuuaaagacgcgcacgcaaagaggcagaccguugugguccugggcagucaggagggggccgugcauacagcuuuggccggagcacuagaagccgagauggauggugcuaagggccggcugagcuccgggcaccucaaaugccgccugaagauggacaaacuuagacugaagggagucucuuauagcuuguguaccgccgcauucacuuuuacgaaaauaccugcggaaacacuccauggcaccgugacuguugaggugcaguacgcugguaccgacgggccaugcaagguacccgcccaaauggcagucgauaugcagacacugaccccugugggcagguuaaucacugccaauccaguuauuacagaaucaacggagaacaguaagaugaugcuggagcuagaucccccguucggagacuccuacaucgugauaggcgucggggagaaaaagauuacccaccacuggcaucguagcggaucuacuaucgguaaggcuuuugaagccacagugcggggcgcaaaacgaauggcuguacucggggacaccgccugggauuucggaucagugggcggugcgcugaauagucuugggaaaggcauccaccagauuuucggagccgcuuuuaagagcuuguucggcgggauguccugguuuucucaaauccugauuggaacacuccugauguggcuuggccugaacacuaagaaugguucgaucagcuugaugugucucgcauuagggggaguucugauauuccuguccaccgccgucucagcugacgugggcugcaguguggauuuuucuaaaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8403 - RNA, 2365 nt, Artificial Sequence
  KX447517.1 prME-long mRNA Design 3 opt
gggagaaagcuuaccaugagaaucauuaacgccaggaaggagaaaaagcggcgcggcgcugacaccagcguggggauagucggacugcuccuuacaacugcaauggccgcggaaguuacgcgacgugguuccgcuuacuauauguaccuggauagaaaugacgccggcgaggcaaucucuuuccccaccacauuggggaugaacaaaugcuauauucagaucauggauuuaggacacaugugugacgccacuaugucauacgaaugcccuaugcuggaugagggcguggaaccagacgauguagacuguuggugcaauaccacaaguaccuggguggucuaugguacuugucaucacaagaaaggggaggcuaggcggagccgcagagcagugacacuaccgucccauucuaccaggaagcuccaaacgcggucgcagacuuggcuggagucacgcgaauacaccaagcaccuuauucgaguugagaacuggaucuuuagaaaucccggauucgcccuggcugccgcggcaauagccugguugcucggcagcaguacaucccagaaagugaucuaucuggucaugauucugcucaucgcuccugccuacucuauuaggugcaucggcgugagcaaccgggauuuuguagaagggauguccggagguacuuggguugacguggucuuagagcauggcgggugugugaccgugauggcacaggauaagccaacagucgacauagagcugguuaccacgacugugucaaauauggcugaaguacguaguuacugcuaugaggccagcauuucugauauggcguccgacucacgcugucccacacaaggagaagccuaccuugacaaacagagcgauacccaguaugugugcaagagaacuuuggucgacaggggcugggguaacggguguggacuguucggcaaaggcagucuagugacaugcgcaaaguuugcuugcucuaagaaaaugaccgggaaguccauccagccugagaaucucgaauaccggauuaugcugagcguucacggaucgcaacacucugguaugaucgugaacgauacgggccaugagaccgacgagaaucgagccaaagucgaaaucacaccaaacucaccccgcgcugaggccgcacuugggggauucggcucccuggguuuggauugugaaccuagaacugggcucgacuuuagugaucuguauuacuuaaccaugaauaacaagcacuggcuggugcauaaagagugguuccacgacauuccacucccguggcacgccggcgcugauacaggaacuccccauuggaauaacaaggaagcgcuuguagaguuuaaagacgcacacgccaagaggcagaccguugugguccugggcagccaggagggggcugugcauacagccuuggcaggagcccuagaagcugagauggauggugccaagggccggcuguccucugggcaccucaaaugccgccugaagauggacaaacuuagacugaagggagucagcuauucauuguguaccgcagcguucacuuuuacgaaaauaccugcugaaacacuccauggcaccgugacuguugaggugcaguacgccgguaccgacgggccaugcaagguacccgcacaaauggccgucgauaugcagacacugaccccugugggcagguuaaucacugcuaacccaguuauuacagaaaguacggaaaauuccaagaugaugcuggagcuagaucccccguucggagacagcuacaucgugauaggcgucggggagaaaaagauuacccaccacuggcaucguucuggaucaacuaucgguaaagccuuugaggcaacagugcggggcgcuaagcgaauggccguacucggggacaccgcgugggauuucggaagugugggcggugcccugaacagccuugggaaaggcauccaccagauuuucggagcugcauuuaaguccuuguucggcgggaugucuugguuuucgcaaacacugaucggaacucuccugauguggcuuggccugaauaccaagaacgguagcauuuccuugaugugucucgccuuagggggaguucugauauuccugucaacggcugucagugccgacgugggcugcucuguggauuuuagcaaaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8404 - RNA, 2365 nt, Artificial Sequence
  KU922923.1 prME-long mRNA Design 3 opt
gggagaaagcuuaccaugagaaucauuaacgccaggaaggagaaaaagcggcgcggcgcugaaaccagcguggggauagucggacugcuccuuacaacugcaauggccgcggagguuacgcgacgugguuccgcuuacuauauguaccuggacagaaaugaugccggcgaagcaaucucuuuccccaccacauuggggaugaacaaaugcuauauucagaucauggacuuaggacacaugugugaugccacuaugucauacgagugcccuaugcuggacgaaggcguggagccagaugacguagauuguuggugcaauaccacaaguaccuggguggucuaugguacuugucaucacaagaaaggggaggcuaggcggagccgcagagcagugacacuaccgucccauucuaccaggaagcuccaaacgcggucgcagacuuggcuggaaucacgcgaguacaccaagcaccuuauucgaguugaaaacuggaucuuuagaaaucccggauucgcccuggcugccgcggcaauagccugguugcucggcagcaguacaucccagaaagugaucuaucuggucaugauucugcucaucgcuuuagccuacucuauuaggugcaucggcgugagcaaccgggacuuuguagaggggauguccggagguacuuggguugaugugguccuggagcauggcgggugugugaccgugauggcacaggacaagccuacagucgauauagaacuuguuaccacgacugugucaaauauggcugagguacguaguuacugcuaugaagccagcauuucugacauggcguccgauucacgcuguccaacacaaggagaggccuacuuggacaaacagagcgacacccaguaugugugcaagagaacucuggucgauaggggcugggguaacggguguggacuauucggcaaaggcagucucgugacaugcgcaaaguuugcuugcucuaagaaaaugaccgggaaguccauccagcccgaaaaucuggaguaccggauuaugcuuagcguucacggaucgcaacacucugguaugaucgugaacgacacgggccaugagaccgaugaaaaucgagccaaagucgagaucacaccuaacuccccacgcgcugaagccacucugggaggguucggcucauugggucucgacugugagcccagaaccgggcuggauuuuagugacuuauauuaccugacaaugaauaacaagcacuggcucgugcauaaagaaugguuccacgauauuccucuuccauggcacgcaggcgccgacacuggaaccccgcauuggaauaacaaggaggcucugguagaguuuaaagaugcgcacgcaaagaggcagacaguuguggucuugggcagccaggaaggggccgugcauaccgcucuagccggagcacuggaggccgaaauggacggugcuaagggccggcucuccucugggcaccugaaaugccgccuuaagauggauaaacugagauugaagggagucagcuauucacucuguacugccgcauucacguuuacaaaaauacccgcggagacccugcauggcacugugaccguugaagugcaguacgcugguacagacgggccuugcaagguaccagcccaaauggcagucgacaugcagaccuuaacucccgugggcaggcugaucacagccaacccuguuauuacggagaguaccgaaaauuccaagaugaugcuagagcucgauccacccuucggagacagcuacaucgugauaggcgucggggagaaaaagauuacucaccacuggcaucguucuggaucaacaaucgguaaggcuuuugaagccaccgugcggggcgcaaaacgaauggcuguacugggggauacagccugggacuucggaagugugggcggugcgcuuaacagcuuggggaaaggcauccaccagauuuucggagccgcuuuuaagucccuguucggcgggaugucuugguuuucgcaaauccucauuggaacucugcuuauguggcugggcuugaauaccaagaacgguagcauaucccucaugugucuggcauuagggggaguucugaucuuccuaucaacggccgucagugcugaugugggcugcucuguggacuuuagcaaaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8405 - RNA, 2365 nt, Artificial Sequence
  KY003156.1 prME-long mRNA Design 3 opt
gggagaaagcuuaccaugagaaucauuaacgccaggaaggagaaaaagcggcgcggcgcugacaccagcguggggauagucggacugcuccuuacaacugcaauggccgcggaaguuacgcgacgugguuccgcuuacuauauguaccuggauagaaaugacgccggcgaggcaaucucuuuccccaccacauuggggaugaacaaaugcuauauucagaucauggauuuaggacacaugugugacgccacuaugucauacgaaugcccuaugcuggaugagggcguggaaccagacgauguagacuguuggugcaauaccacaaguaccuggguggucuaugguacuugucaucacaagaaaggggaggcuaggcggagccgcagagcagugacacuaccgucccauucuaccaggaagcuccaaacgcggucgcagacuuggcuggagucacgcgaauacaccaagcaccuuauucgaguugagaacuggaucuuuagaaaucccggauucgcccuggcugccgcggcaauagccugguugcucggcagcaguacaucccagaaagugaucuaucuggucaugauucugcucaucgcuccugccuacucuauuaggugcaucggcauaagcaaccgggauuuuguggaagggauguccggagguacuuggguagacguuguguuagagcauggcgggugugucaccgugauggcacaggauaagccaacaguggacauugagcuggucaccacgacuguuucaaauauggcugaagugcguaguuacugcuaugaggccagcaucucugauauggcguccgacucacgcugucccacacaaggagaagccuaccuugacaaacagagcgauacccaguauguaugcaagagaacuuugguggacaggggcugggguaacggguguggacuguucggcaaaggcagucuagucacaugcgcaaaguuugcuugcucuaagaaaaugaccgggaaguccauucagccugagaaucucgaauaccggaucaugcugagcgugcacggaucgcaacacucugguaugaucguuaacgauacgggccaugagaccgacgagaaucgagccaaaguggaaauuacaccaaacucaccccgcgcugaggccacucuugggggauucggcauacuggguuuggauugugaaccuagaaccgggcucgacuuuuccgaucuguauuacuuaacaaugaauaacaagcacuggcugguccauaaagagugguuccacgacaucccacucccguggcacgcaggcgccgauacuggaacaccccauuggaauaacaaggaagcucuuguggaguuuaaagacgcgcacgcaaagaggcagaccguaguugugcugggcagucaggagggggccguccauaccgcuuuggccggagcacuagaagccgagauggauggugcuaagggccggcugagcuccgggcaccucaaaugccgccugaagauggacaaacuuagacugaagggagugucuuauagcuuguguacugccgcauucacguuuacaaaaauuccugcggaaacccuccauggcacugucaccguggagguucaguacgcugguacagacgggccaugcaaggugcccgcccaaauggcaguagauaugcagacccugacuccugucggcagguuaaucacagccaacccagugauaacggaaucaaccgagaauaguaagaugaugcuggagcuagaucccccguucggagacuccuacauuguuaucggcgugggggagaaaaagaucacucaccacuggcaucguagcggaucuacaauugguaaggcuuuugaagccaccguccggggcgcaaaacgaauggcugugcucggggacacagccugggauuucggaucaguaggcggugcgcugaacagucuugggaaaggcauccaccagauuuucggagccgcuuuuaagagcuuguucggcgggauguccugguuuucucaaauacugaucggaacucuccugauguggcuuggccugaauaccaagaacgguucgauuagcuugaugugucucgcauuagggggagugcugaucuuccuguccacggccguuucagcugacgucggcugcaguguggauuuuucuaaaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8406 - RNA, 2365 nt, Artificial Sequence
  KU312313.1 prME-long mRNA Design 3 opt
gggagaaagcuuaccaugagaaucauuaacgccaggaaggagaaaaagcggcgcggcgcugacaccagcguggggauagucggacugcuccuuacaacugcaauggccgcggaaguuacgcgacgugguuccgcuuacuauauguaccuggauagaaaugacgccggcgaggcaaucucuuuccccaccacauuggggaugaacaaaugcuauauucagaucauggauuuaggacacacuugugacgccaccaugucauacgaaugcccuaugcuggaugagggcguggaaccagacgauguagacuguuggugcaauacaaccaguacuuggguggucuaugguacaugucaucacaagaaaggggaggcuaggcggagccgcagagcagugacccuaccgucccauucuauuaggaagcuccaaacgcggucgcagacuuggcuggagucacgcgaauacaccaagcaccuuauccgaguugagaacuggauauuuagaaaucccggauucgcccuggcugccgcggcaaucgccugguugcucggcagcaguacaucccagaaagugauuuaucuggucaugauccugcucauugcuccugccuacucuaucaggugcauaggcgugagcaaccgggauuuuguagaagggauguccggagguacuuggguugacguggucuuagagcauggcgggugugugaccgugauggcacaggauaagccaacagucgacauugagcugguuaccacgacugugucaaauauggcugaaguacguaguuacugcuaugaggccagcaucucugauauggcguccgacucacgcugucccacacaaggagaagccuaccuugacaaacagagcgauacccaguaugugugcaagagaacuuuggucgacaggggcugggguaacggguguggacuguucggcaaaggcagucuagugacaugcgcaaaguuugcuugcucuaagaaaaugaccgggaaguccauucagccugagaaucucgaauaccggaucaugcugagcguucacggaucgcaacacucugguaugaucgugaacgauacgggccaugagaccgacgagaaucgagccaaagucgaaauuacaccaaacucaccccgcgcugaggccacucuugggggauucggcucccuggguuuggauugugaaccuagaaccgggcucgacuuuagugaucuguauuacuuaacaaugaauaacaagcacuggcuggugcauaaagagugguuccacgacauaccacucccguggcacgcaggcgccgauacuggaacaccccauuggaauaacaaggaagcucuuguagaguuuaaagacgcgcacgcaaagaggcagaccguugugguccugggcagccaggagggggccgugcauaccgcuuuggccggagcacuagaagccgagauggauggugcuaagggccggcuguccucugggcaccucaaaugccgccugaagauggacaaacuuagacugaagggagucagcuauucauuguguacugccgcauucacguuuacaaaaaucccugcggaaacccuccauggcacugugaccguugaggugcaguacgcugguacagacgggccaugcaagguacccgcccaaauggcagucgauaugcagacccugacuccugugggcagguuaauuacagccaacccaguuaucacggaaaguaccgaaaauuccaagaugaugcuggagcuagaucccccguucggagacagcuacauagugauuggcgucggggagaaaaagaucacucaccacuggcaucguucuggaucaacaaucgguaaggcuuuugaggccaccgugcggggcgcaaaacgaauggcuguacucggggacacagccugggauuucggaagugugggcggugcgcugaacagccuugggaaaggcauucaccagaucuucggagccgcuuuuaaguccuuguucggcgggaugucuugguuuucgcaaauucugauaggaacucuccugauguggcuuggccugaaugcaaagaacgguagcaucuccuugaugugucucgccuuagggggaguucugauuuuccugucaaccgcugucagugccgacgugggcugcucuguggauuuuagcaaaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8407 - RNA, 2365 nt, Artificial Sequence
  KY075935.1 prME-long mRNA Design 3 opt
gggagaaagcuuaccaugagaaucauuaacgccaggaaggagaaaaagcggcgcggcgcugacaccagcguggggauagucggacugcuccuuacaacugcaauggccgcggaaguuacgcgacgugguuccgcuuacuauauguaccuggauagaaaugacgccggcgaggcaaucucuuuccccaccacauuggggaugaacaaaugcuauauucagaucauggauuuaggacacaugugugacgccacuaugucauacgaaugcccuaugcuggaugagggcguggaaccagacgauguagacuguuggugcaauaccacaaguaccuggguggucuaugguacuugucaucacaagaaaggggaggcucaaaggagccggcgcgcagugacacuaccgucccauucuaccagaaagcuccagacgaggucgcagacuuggcuggagucacgggaauacaccaagcaccuuauucgcguugagaacuggaucuuucgaaaucccggauucgcccuggcugccgcggcaauagccugguugcucggcagcaguacaucccagaaagugaucuaucuggucaugauucugcucaucgcuccugccuacucuauuagaugcaucggcgugagcaacagggauuuuguagaagggauguccggagguacuuggguugacguggucuuagagcauggcgggugugugaccgugauggcacaagauaagccaacagucgacauagagcugguuaccacgacugugucaaauauggcugaaguacggaguuacugcuaugaggccagcauuucugauauggcguccgacucacguugucccacacagggagaagccuaccuugacaaacagagcgauacccaguaugugugcaagcgcacuuuggucgacagaggcugggguaacggguguggacuguucggcaaaggcagucuagugacaugcgcaaaguuugcuugcucuaagaaaaugaccgggaaguccauccaaccugagaaucucgaauacaggauuaugcugagcguucacggaucgcagcacucugguaugaucgugaacgauacgggccaugagaccgacgagaaucgggccaaagucgaaaucacaccaaacucaccccgagcugaggccacucuugggggauucggcucccuggguuuggauugugaaccucgcaccgggcucgacuuuagugaucuguauuacuuaacaaugaauaacaagcacuggcuggugcauaaagagugguuccacgacauuccacucccguggcacgcaggcgccgauacuggaacaccccauuggaauaacaaggaagcucuuguagaguuuaaagacgcgcacgcaaagagacagaccguugugguccugggcagccaggagggggccgugcauaccgcuuuggccggagcacuagaagccgagauggauggugcuaagggcaggcuguccucugggcaccucaaaugccggcugaagauggacaaacuucgccugaagggagucagcuauucauuguguacugccgcauucacguuuacaaaaauaccugcggaaacccuccauggcacugugaccguugaggugcaauacgcugguacagacgggccaugcaagguacccgcccagauggcagucgauaugcagacccugacuccugugggcagauuaaucacagccaacccaguuauuacggaaaguaccgaaaauuccaagaugaugcuggagcuagaucccccguucggagacagcuacaucgugauaggcgucggggagaaaaagauuacucaccacuggcauaggucuggaucaacaaucgguaaggcuuuugaggccaccgugcguggcgcaaaacggauggcuguacucggggacacagccugggauuucggaagugugggcggugcgcugaacagccuugggaaaggcauccaccaaauuuucggagccgcuuuuaaguccuuguucggcgggaugucuugguuuucgcagauccugauuggaacucuccugauguggcuuggccugaauaccaagaacgguagcauauccuugaugugucucgcauuagggggaguucugaucuuccugucaacggccgucagugcugacgugggcugcucuguggauuuuagcaaaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8408 - RNA, 2365 nt, Artificial Sequence
  KY014320.1 prME-long mRNA Design 3 opt
gggagaaagcuuaccaugagaaucauuaacgccaggaaggagaaaaagcggcgcggcgcugacaccagcguggggauagucggacugcuccuuacaacugcaauggccgcggaaguuacgcgacgugguuccgcuuacuauauguaccuggauagaaaugacgccggcgaggcaaucucuuuccccaccacauuggggaugaacaaaugcuauauucagaucauggauuuaggacacaugugugacgccacuaugucauacgaaugcccuaugcuggaugagggcguggaaccagacgauguagacuguuggugcaauaccacaaguaccuggguggucuaugguacuugucaucacaagaaaggggaggcuaggcggagccgcagagcagugacacuaccgucccauucuaccaggaagcuccaagcccggucgcagacguggcuggagucacgcgaauacacuaagcaccuuauucgaguugagaacuggaucuuuagaaaucccggauucgcucuggccgcggcagccauagcuugguugcucggcagcaguaccucccagaaagugaucuaucuggucaugauucugcucaucgccccugcauacucuauuaggugcaucggcgugagcaaccgggauuuuguagaagggauguccggagguacauggguugacguggucuuagagcauggcgggugugugacugugauggcucaggauaagccaaccgucgacauagagcugguuacaaccacggugucaaauauggccgaaguacguaguuacugcuaugaggcgagcauuucugauauggccuccgacucacgcugucccacucaaggagaagcauaccuugacaaacagagcgauacacaguaugugugcaagagaaccuuggucgacaggggcugggguaacggguguggacuguucggcaaaggcagucuagugacuugcgcuaaguuugccugcucuaagaaaaugacagggaaguccauccagccugagaaucucgaauaccggauuaugcugagcguucacggaucgcaacacucugguaugaucgugaacgauaccggccaugagacggacgagaaucgagcuaaagucgaaaucaccccaaacucaccccgcgccgaggcaacacuugggggauucggcucccuggguuuggauugugaaccuagaacugggcucgacuuuagugaucuguauuacuuaaccaugaauaacaagcacuggcuggugcauaaagagugguuccacgacauuccacucccguggcacgccggcgcugauacaggaacuccccauuggaauaacaaggaagcgcuuguagaguuuaaagacgcacacgccaagaggcagaccguugugguccugggcagccaggagggggcugugcauacagccuuggcaggagcccuagaagcugagauggauggugccaagggccggcuguccucugggcaccucaaaugccgccugaagauggacaaacuuagacugaagggagucagcuauucauuguguaccgcagcguucacuuuuacgaaaauaccugcugaaacacuccauggcaccgugacuguugaggugcaguacgccgguaccgacgggccaugcaagguacccgcacaaauggccgucgauaugcagacacugaccccugugggcagguuaaucacugcuaacccaguuauuacagaaaguacggaaaauuccaagaugaugcuggagcuagaucccccguucggagacagcuacaucgugauaggcgucggggagaaaaagauuacccaccacuggcaucguucuggaucaacuaucgguaaagccuuugaggcaacagugcggggcgcuaagcgaauggccguacucggggacaccgcgugggauuucggaagugugggcggugcccugaacagccuugggaaaggcauccaccagauuuucggagcugcauuuaaguccuuguucggcgggaugucuugguuuucgcaaauccugauuggaacacuccugauguggcuuggccugaauacuaagaacgguagcauauccuugaugugucucgccuuagggggaguucugaucuuccugucaaccgcugucagugccgacgugggcugcucuguggauuuuagcaaaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8409 - RNA, 2365 nt, Artificial Sequence
  KX827309.1 prME-long mRNA Design 3 opt
gggagaaagcuuaccaugagaaucauuaacgccaggaaggagaaaaagcggcgcggcgcugacaccagcguggggauagucggacugcuccuuacaacugcaauggccgcggaaguuacgcgacgugguuccgcuuacuauauguaccuggauagaucugacgccggcgaggcaaucucauuccccaccacauuggggaugaauaaaugcuauauucagaucauggauuuaggacacaugugugacgccacuaugaguuacgaaugcccuaugcuggaugagggcguggaaccagacgauguagacuguuggugcaacaccacaagcaccuggguggucuaugguacuugucaucacaagaaaggggaggcuaggcggucccgcagagcagugacacuaccgucucauucgaccaggaagcuccaaacgcggucacagacuuggcuggagagccgcgaauacaccaagcaccuuauucgaguugagaauuggaucuuuagaaaccccggauucgcccuggcugccgcggcaauagccugguugcucggcaguuccacaucucagaaagugaucuaucuggucaugauucugcucaucgcuccugccuacagcauuaggugcaucggcguguccaaucgggauuuuguagaagggaugucaggagguacuuggguugacguggucuuagagcauggcgggugugugaccgugauggcacaggauaagccaacagucgacauagagcugguuaccacgacugugaguaacauggcugaaguacguagcuacugcuaugaggccucuauuuccgauauggcgucagacagccgcugucccacacaaggagaagccuaccuugacaaacagagugauacccaguaugugugcaagagaacuuuggucgacaggggcugggguaauggguguggacuguucggcaaaggcucucuagugacaugcgcaaaguuugcuugcuccaagaaaaugaccgggaaaagcauccagccugagaaccucgaauaccggauuaugcugucgguucacggaucucaacacuccgguaugaucgugaaugauacgggccaugagaccgacgagaaccgagccaaagucgaaaucacaccaaauucaccccgcgcugaggccacucuugggggauucggcagucuggguuuggauugugaaccuagaaccgggcucgacuuuagcgaucuguauuacuuaacaaugaacaauaagcacuggcuggugcauaaagagugguuccacgacauuccacucccguggcacgcaggcgccgauacuggaacaccccauuggaacaauaaggaagcucuuguagaguuuaaagacgcgcacgcaaagaggcagaccguugugguccugggcucccaggagggggccgugcauaccgcuuuggccggagcacuagaagccgagauggauggugcuaagggccggcugucuagcgggcaccucaaaugccgccugaagauggacaaacuuagacugaagggagucucauauaguuuguguacugccgcauucacguuuacaaaaauaccugcggaaacccuccauggcacugugaccguugaggugcaguacgcugguacagacgggccaugcaagguacccgcccaaauggcagucgauaugcagacccugacuccugugggcagguuaaucacagccaacccaguuauuacggaauccaccgagaacagcaagaugaugcuggagcuagaucccccguucggagacucuuacaucgugauaggcgucggggagaaaaagauuacucaccacuggcaucguucaggaaguacaaucgguaaggcuuuugaagccaccgugcggggcgcaaagcgaauggcuguacucggggacacagccugggauuucggaagcgugggcggugcgcuuaauucccuggggaaaggcauccaccagauuuucggagccgcuuuuaagucuuuguucggcgggaugucgugguuuagccaaauccugauuggaacucuccugauguggcuuggccugaacaccaagaaugguuccauaucauugaugugucucgcauuagggggaguucugaucuuccugaguacggccgucucugcugacgugggcugcagcguggauuuuuccaaaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8410 - RNA, 2365 nt, Artificial Sequence
  KU681081.3 prME-long mRNA Design 3 opt
gggagaaagcuuaccaugagaaucauuaacgccaggaaggagaaaaagcggcgcggcaccgacacaagcguggggauagucggacugcuccuuacuacggcuauggcagccgaaguuacccgacgugguuccgcguacuauauguaccuggauagaucugacgcuggcgaggccaucucauuccccacaacuuuggggaugaauaaaugcuauauucagaucauggauuuaggacacaugugugacgcaaccaugaguuacgaaugcccuaugcuggaugagggcguggaaccagacgauguagacuguuggugcaacacaaccagcacuuggguggucuaugguacaugucaucacaagaaaggggaggccaggcggucccgcagagcugugacccuaccgucucauucgacgaggaagcuccaaacucggucacagaccuggcuggagagccgcgaauacacaaagcaccuuauucgaguugagaauuggaucuuuagaaaccccggauucgcacuggccgcugccgcgauagcaugguugcucggcaguuccacuucucagaaagugaucuaucuggucaugauucugcucaucgccccugcuuacagcauuaggugcaucggcguguccaaucgggauuuuguagaagggaugucaggagguaccuggguugacguggucuuagagcauggcgggugugugacagugauggcccaggauaagccaaccgucgacauagagcugguuacgacuacagugaguaacauggcagaaguacguagcuacugcuaugaggcuucuauuuccgauauggccucagacagccgcugucccacccaaggagaagcguaccuugacaaacagagugauacucaguaugugugcaagagaacauuggucgacaggggcugggguaauggguguggacuguucggcaaaggcucucuagugaccugcgccaaguuugcaugcuccaagaaaaugacggggaaaagcauccagccugagaaccucgaauaccggauuaugcugucgguucacggaucucaacacuccgguaugaucgugaaugauaccggccaugagacagacgagaaccgagcuaaagucgaaaucacuccaaauucaccccgcgccgaggcuacccuugggggauucggcagucuggguuuggauugugaaccuagaacagggcucgacuuuagcgaucuguauuacuuaacuaugaacaauaagcacuggcuggugcauaaagagugguuccacgacauuccacucccguggcacaccggcgccgauacaggaacuccccauuggaacaauaaggaagcacuuguagaguuuaaagacgcccacgcuaagaggcagaccguugugguccugggcucccaggagggggcggugcauacggcauuggccggagcucuagaagccgagauggauggugcaaagggccggcugucuagcgggcaccucaaaugccgccugaagauggacaaacuuagacugaagggagucucauauaguuuguguacagccgcuuucaccuuuacuaaaauaccugccgaaacccuccauggcacagugaccguugaggugcaguacgcagguacugacgggccaugcaagguacccgcgcaaauggcugucgauaugcagacacugacgccugugggcagguuaaucaccgccaacccaguuauuacugaaggaacagagaacuccaagaugaugcuggagcuagaucccccguucggcgacagcuacaucgugauaggggucggagaaaagaagauuacccaccacuggcaucguucugguucaacaaucggcaaagcauuugaggccacugugcgaggggcuaagcggauggccguacucggagacaccgcaugggauuucggcagugugggugggguucugaauagccuuggcaaaggaauccaccagauuuucggcgcugccuuuaaguccuuguucgggggaaugucuugguuuucgcaaauccugauuggcacgcuccugauguggcuuggucugaacaccaagaaugggagcauauccuugaugugucucgcgcugggaggcgucuuaaucuuccugucaacagccgugagugcugacguggguugcucugucgauuuuagcaaaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8411 - RNA, 2365 nt, Artificial Sequence
  KU744693.1 prME-long mRNA Design 3 opt
gggagaaagcuuaccaugagaaucauuaacgccaggaaggagaaaaagcggcgcggcgcugacaccagcguggggauagucggacugcuccuuacaacugcaauggccgcggaaguuacgcgacgugguuccgcuuacuauauguaccuggauagaaaugacgccggcgaggcaaucucuuuccccaccacauuggggaugaacaaaugcuauauucagaucauggauuuaggacacaugugugacgccacuaugucauacgaaugcccuaugcuggaugagggcguggaaccagacgauguagacuguuggugcaauaccacaaguaccuggguggucuaugguacuugucaucacaagaaaggggaggcuaggcggagccgcagagcagugacacuaccgucccauucuaccaggaagcuccaaacgcggucgcagacuuggcuggagucacgcgaauacaccaagcaccuuauucgaguugagaacuggaucuuuagaaaucccggauucgcccuggcugccgcggcaauagccugguugcucggcagcaguacaucccagaaagugaucuaucuggucaugauucugcucaucgcuccugccuacucuauuaggugcaucggcgugagcaaccgggauuuuguagaagggauguccggagguacuuggguugacguggucuuagagcauggcgggugugugaccgcaauggcucaggauaagccaacaguggacauagagcuggucaccacgacuguuucaaauauggccgaagugcguaguuacugcuaugaggcgagcauuucugauauggccuccgacucacgcugucccacacaaggagaagcauaccuugacaaacagagcgauacccaguauguaugcaagagaacuuugguggacaggggcugggguaacggguguggacuguucggcaaaggcagucuagucacaugcgcuaaguuugccugcucuaagaaaaugaccgggaaguccauccagccugagaaucucgaauaccggauuaugcugagcgugcacggaucgcaacacucugguaugcuuguuaacgauacgggccaugagaccgacgagaaucgagcuaaaguggaaaucacaccaaacucaccccgcgccgaggcaacucugggaggguucggcuccuugggucucgauugugaaccuagaaccgggcuggacuuuagugauuuauauuaccugacaaugaauaacaagcacuggcucgcccauaaagagugguuccacgacaucccacuuccguggcacgcuggcgcggcaacuggaacaccccauuggaauaacaaggaagcccuggucgaguuuaaagaugcucacgccaagaggcagaccgugguaguuuugggcagccaggagggggcagugcauaccgcccuagcuggagcccuggaagcagagauggacggugcgaagggccggcucuccucugggcaccugaaaugccgccuuaagauggauaaacugagauugaagggagucagcuauucacucuguacugcugccuucacguuuacaaaaauuccugcagaaaccguggacggcacugucaccguggagggucaguacgggggcacagacggaccaugcaagguucccgcccaaauggcuguggauaugcagacccugacuccuguaggcagguuaauaacagccaacccagucaucacggaaaguaccgaaaauuccaagaugaugcuggagcuagaucccccguucggggacagcuacauugugaucggaguuggugagaaaaagauaacucaucacuggcaccguucuggcucaacaauugggaaagcauuugaggcuaccgugcggggagccaagcgaauggcgguccucggcgacacagccugggauuucgguaguguagggggcgcucugaacagccuuggaaaaggcauccaucagaucauuggggcagccuucaaguccuuguuuggaggcaugucuugguucucgcaaauccugauugguacucuccugauguggcuugggcugaauaccaagaacggaagcauauccuugaugugucucgcucugggcgguguguuaaucuuucugucaacggccgugaguggcgggguuggaugcucugucgacuucagcaaaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8412 - RNA, 2365 nt, Artificial Sequence
  KY328290.1 prME-long mRNA Design 3 opt
gggagaaagcuuaccaugagaaucauuaacgccaggaaggagaaaaagcggcgcggcaccgacacaagcguggggauagucggacugcuccuuacuacggcuauggcagccgaaguuacccgacgugguuccgcguacuauauguaccuggauagaucugacgcuggcgaggccaucucauuccccacaacuuuggggaugaauaaaugcuauauucagaucauggauuuaggacacaugugugacgcaaccaugaguuacgaaugcccuaugcuggaugagggcguggaaccagacgauguagacuguuggugcaacacaaccagcacuuggguggucuaugguacaugucaucacaagaaaggggaggccaggcggucccgcagagcugugacccuaccgucucauucgacgaggaagcuccaaacucggucacagaccuggcuggagagccgcgaauacacaaagcaccuuauucgaguugagaauuggaucuuuagaaaccccggauucgcacuggccgcugccgcgauagcaugguugcucggcaguuccacuucucagaaagugaucuaucuggucaugauucugcucaucgccccugcuuacagcauuaggugcaucggcguguccaaucgggauuuuguagaagggaugucaggagguaccuggguugacguggucuuagagcauggcgggugugugacagugauggcccaggauaagccaaccgucgacauagagcugguuacgacuacagugaguaacauggcagaaguacguagcuacugcuaugaggcuucuauuuccgauauggccucagacagccgcugucccacccaaggagaagcguaccuugacaaacagagugauacucaguaugugugcaagagaacauuggucgacaggggcugggguaauggguguggacuguucggcaaaggcucucuagugaccugcgccaaguuugcaugcuccaagaaaaugacggggaagucuauccagccugagaaccucgaauaccggauuaugcugucgguucacggaucucaacacuccgguaugaucgugaaugauaccggccaugagacagacgagaaccgagcuaaagucgaaaucacuccaaauucaccccgcgccgaggcuacccuugggggauucggcagucuggguuuggauugugaaccuagaacagggcucgacuuuagcgaucuguauuacuuaacuaugaacaauaagcacuggcuggugcauaaagagugguuccacgacauuccacucccguggcacgccggcgcagauaccggaacaccccauuggaacaauaaggaagcccuuguagaguuuaaagacgcucacgcgaagaggcagaccguugugguccugggcucccaggagggggcagugcauacugccuuggcuggagcccuagaagcagagauggauggugccaagggccggcugucuagcgggcaccucaaaugccgccugaagauggacaaacuuagacugaagggagucucauauaguuuguguacggcugccuucacauuuuccaaaauaccugcagaaacccuccauggcacugugaccgaggaaguucaguacgcggguacagacgggccaugcaaggugcccgcucaaauggccguagauaugcagacccugacuccugucggcagguuaaucacagcaaacccagugauuacggagagcaccgagaacucuaagaugaugcuggaacuagaucccccguucggagacucauacaucguuauaggcgugggggagaaaaagauuacucaccacuggcaucguaguggaagcacaaucgguaaagccuuugaagcuaccguccggggcgccaagcgaauggcagugcucggggacacagcuugggauuucggauccguaggcggugcccugaauagccuugggaaaggcauccaccagauuuucggagcggccuuuaagucguuguucggcgggaugagcugguuuucccaaauccugauuggaacucuccugauguggcuuggccugaacaccaagaaugguucaauaaguuugaugugucucgcuuuagggggagugcugaucuuccugucuacggcaguuagcgccgacgucggcugcuccguggauuuuucaaaaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8413 - RNA, 2365 nt, Artificial Sequence
  KX694532.2 prME-long mRNA Design 3 opt
gggagaaagcuuaccaugagaaucauuaacgccaggaaggagaaaaagcggcgcggcaccgacacaagcguggggauagucggacugcuccuuacuacggcuauggcagccgaaguuacccgacgugguuccgcguacuauauguaccuggauagaucugacgcuggcgaggccaucucauuccccacaacuuuggggaugaauaaaugcuauauucagaucauggauuuaggacacaugugugacgcaaccaugaguuacgaaugcccuaugcuggaugagggcguggaaccagacgauguagacuguuggugcaacacaaccagcacuuggguggucuaugguacaugucaucacaagaaaggggaggccaggcggucccgcagagcugugacccuaccgucucauucgacgaggaagcuccaaacucggucacagaccuggcuggagagccgcgaauacacaaagcaccuuauucgaguugagaauuggaucuuuagaaaccccggauucgcacuggccgcugccgcgauagcaugguugcucggcaguuccacuucucagaaagugaucuaucuggucaugauucugcucaucgccccugcuuacagcauuaggugcaucggcguguccaaucgggauuuuguagaagggaugucaggagguaccuggguugacguggucuuagagcauggcgggugugugacagugauggcccaggauaagccaaccgucgacauagagcugguuacgacuacagugaguaacauggcagaaguacguagcuacugcuaugaggcuucuauuuccgauauggccucagacagccgcugucccacccaaggagaagcguaccuugacaaacagagugauacucaguaugugugcaagagaacauuggucgacaggggcugggguaauggguguggacuguucggcaaaggcucucuagugaccugcgccaaguuugcaugcuccaagaaaaugacggggaaaagcauccagccugagaaccucgaauaccggauuaugcugucgguucacggaucucaacacuccgguaugaucgugaaugauaccggccaugagacagacgagaaccgagcuaaagucgaaaucacuccaaauucaccccgcgccgaggcuacccuugggggauucggcagucuggguuuggauugugaaccuagaacagggcucgacuuuagcgaucuguauuacuuaacuaugaacaauaagcacuggcuggugcauaaagagugguuccacgacauuccacucccguggcacgccggcgcagauaccggaacaccccauuggaacaauaaggaagcccuuguagaguuuaaagacgcucacgcgaagaggcagaccguugugguccugggcucccaggagggggcagugcauacugccuuggcuggagcccuagaagcagagauggauggugccaagggccggcugucuagcgggcaccucaaaugccgccugaagauggacaaacuuagacugaagggagucucauauaguuuguguacggcugccuucacauuuaccaaaauaccugcagaaacucuccauggcaccgugacaguugaggugcaguacgcggguaccgacgggccaugcaagguacccgcucaaauggccgucgauaugcagacucugacaccugugggcagguuaaucacggcaaacccaguuauuaccgaauccacugagaacagcaagaugaugcuggagcuagaucccccguucggagacucuuacaucgugauaggcgucggggaaaagaagauuacacaccacuggcaucguucaggaaguaccaucgguaaagccuuugaggcuacagugcggggcgccaagcgaauggcaguacucggggacacugcuugggauuucggaagcgugggcggugcccuuaauucccuggggaaaggcauccaccagauuuucggagcggccuuuaagucuuuguucggcgggaugucgugguuuagccaaauccugauuggaacccuccugauguggcuuggccugaacacgaagaaugguuccauaucauugaugugucucgcuuuagggggaguucugaucuuccugaguaccgcagucucugccgacgugggcugcagcguggauuuuuccaaaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8414 - RNA, 2365 nt, Artificial Sequence
  KU955593.1 prME-long mRNA Design 3 opt
gggagaaagcuuaccaugagaaucauuaacgccaggaaggagaaaaagcggcgcggcaccgacacaagcguggggauagucggacugcuccuuacuacggcuauggcaguugaagugacccgacgugguaaugccuacuauauguaccuggauagauccgacgcgggcgaggcuaucucuuuccccacaacuauggggaugaacaaaugcuauauucagaucauggauuugggacacaugugugacgccaccaugucauacgaaugcccuauguuagaugagggcguagaaccagacgauguggacuguuggugcaauacaaccaguacuugggucguguaugguacaugucaucacaagaaaggggaggcaaggcggagccgcagagccguuacccugccgucccauucuacgaggaagcuacaaacucggucgcagaccuggcucgagucacgcgaauacacaaagcaccugauucgaguggagaacuggaucuuuagaaaucccggauucgcucuugcagccgcugccauagcguggcuguugggcagcaguacuucccagaaagucaucuaucucgugaugauucugcugaucgcacccgccuacucuauuaggugcaucggcguaagcaaccgggauuuuguugaagggauguccggagguaccuggguggacgucgugcucgagcauggcgggugugugacagucauggcucaggauaagccaaccguugacauagaguuagugacgacuacaguaucaaauauggccgaagugcguaguuacugcuaugaggcaagcauuucugauauggcuuccgacucacgcugucccacccaaggagaagccuaccuggacaaacagagcgauacucaguaugucugcaagagaacacuuguggacaggggcugggguaacggguguggauuguucggcaaaggcagucugguuaccugcgcgaaguuugccugcucuaagaaaaugacggggaaguccauccagccugagaaucuagaauaccggauuaugcucagcgugcacggaucgcaacacucugguaugaucgucaacgauaccggccaugagacagacgagaaucgagcaaaaguggaaaucacuccaaacuccccucgcgcugaggccacccuugggggauucggcucacugggucuggauugugaaccuagaacaggguuggacuuuagugaucucuauuaccugacuaugaauaacaagcacugguuaguacauaaagagugguuccacgacauuccacugccguggcacgcuggcgccgauaccggaacaccccauuggaauaacaaggaagcacucguugaguuuaaagacgcccacgcuaagaggcagaccguggucgugcuuggcagccaggagggggcgguccauacugcacuggccggagcuuuggaagccgagauggauggugcaaagggccggcuauccucugggcaccugaaaugccgccucaagauggacaaacugagacuuaagggagugagcuauucacuguguacggccgcuuucacauuuaccaaaauaccugccgaaacuuugcauggcaccguuacaguggagguacaguacgcagguaccgacgggccaugcaagguccccgcgcaaauggcuguggauaugcagacucucacaccuguuggcaggcugaucacggccaacccagugauuaccgaaaguacugaaaauuccaagaugauguuagagcuggaucccccguucggagacagcuacaucgucauaggcgugggggagaaaaagauuacacaccacuggcaucguucuggaucaaccaucgguaaagcauuugaggccacaguacggggcgcuaagcgaauggccgugcuaggggacacugcaugggauuucggaaguguuggcggugcucucaacagccuggggaaaggcauccaccagauuuucggagccgcguuuaagucccuuuucggcgggaugucuugguuuucgcaaaucuugauuggaacccugcucgucuggcugggccuuaauacgaagaacgguagcauaucccugauguguuuggcccucgggggagugcugaucuucuuaucaaccgcugugagugcagacgucggcugcucuguugauuuuagcaaaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8415 - RNA, 2365 nt, Artificial Sequence
  KY272987.1 prME-long mRNA Design 3 opt
gggagaaagcuuaccaugagaaucauuaacgccaggaaggagaaaaagcggcgcggcaccgacacaagcguggggauagucggacugcuccuuacuacggcuauggcagccgaaguuacccgacgugguuccgcguacuauauguaccuggauagaucugacgcuggcgaggccaucucauuccccacaacuuuggggaugaauaaaugcuauauucagaucauggauuuaggacacaugugugacgcaaccaugaguuacgaaugcccuaugcuggaugagggcguggaaccagacgauguagacuguuggugcaacacaaccagcacuuggguggucuaugguacaugucaucacaagaaaggggaggccaggcggucccgcagagcugugacccuaccgucucauucgacgaggaagcuccaaacucggucacagaccuggcuggagagccgcgaauacacaaagcaccuuauucgaguugagaauuggaucuuuagaaaccccggauucgcacuggccgcugccgcgauagcaugguugcucggcaguuccacuucucagaaagugaucuaucuggucaugauucugcucaucgccccugcuuacagcauuaggugcaucggcguguccaaucgggauuuuguagaagggaugucaggagguaccuggguugacguggucuuagagcauggcgggugugugacagugauggcccaggauaagccaaccgucgacauagagcugguuacgacuacagugaguaacauggcagaaguacguagcuacugcuaugaggcuucuauuuccgauauggccucagacagccgcugucccacccaaggagaagcguaccuugacaaacagagugauacucaguaugugugcaagagaacauuggucgacaggggcugggguaauggguguggacuguucggcaaaggcucucuagugaccugcgccaaguuugcaugcuccaagaaaaugacggggaaaagcauccagccugagaaccucgaauaccggauuaugcugucgguucacggaucucaacacuccgguaugaucgugaaugauaccggccaugagacagacgagaaccgagcuaaagucgaaaucacuccaaauucaccccgcgccgaggcuacccuugggggauucggcagucuggguuuggauugugaaccuagaacagggcucgacuuuagcgaucuguauuacuuaacuaugaacaauaagcacuggcuggugcauaaagagugguuccacgacauuccacucccguggcacgccggcgcagauaccggaacaccccauuggaacaauaaggaagcccuuguagaguuuaaagacgcucacgcgaagaggcagaccguugugguccugggcucccaggagggggcagugcauacugccuuggcuggagcccuagaagcagagauggauggugccaagggccggcugucuagcgggcaccucaaaugccgccugaagauggacaaacuuagacugaagggagucucauauaguuuguguacggcugccuucacauuuaccaaaauaccugcagaaacucuccauggcaccgugacaguugaggugcaguacgcggguaccgacgggccaugcaagguacccgcucaaauggccgucgauaugcagacucugacaccugugggcagguuaaucacggcaaacccaguuauuaccgaauccacugagaacagcaagaugaugcuggagcuagaucccccguucggagacucuuacaucgugauaggcgucggggaaaagaagauuacacaccacuggcaucguucaggaaguaccaucgguaaagccuuugaggcuacagugcggggcgccaagcgaauggcaguacucggggacacugcuugggauuucggaagcgugggcggugcccuuaauucccuggggaaaggcauccaccagauuuucggagcggccuuuaagucuuuguucggcgggaugucgugguuuagccaaauccugauuggaacccuccugauguggcuuggccugaacacgaagaaugguuccauaucauugguuugucucgcuuuagggggaguccugaucuuccugaguaccgcagugucugccgacgugggcugcagcgucgauuuuuccaaaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8416 - RNA, 2365 nt, Artificial Sequence
  EU545988.1 prME-long mRNA Design 3 opt
gggagaaagcuuaccaugagaaucauuaacgccaggaaggagaaaaagcggcgcggcaccgacacaagcguggggauagucggacugcuccuuacuacggcuauggcaguugaagugacccgacgugguuccgccuacuauauguaccuggauagaucugacgcgggcgaggcuaucucauuccccacaacuuuggggaugaauaaaugcuauauucagaucauggauuuaggacacaugugugacgccaccaugaguuacgaaugcccuaugcuggaugagggcguagaaccagacgauguggacuguuggugcaacacaaccagcacuugggucguguaugguacaugucaucacaagaaaggggaggcaaggcggucccgcagagccguuacccuaccgucucauucgacgaggaagcuccaaacucggucacagaccuggcuggagagccgcgaauacacaaagcaccuuauucgaguggagaauuggaucuuuagaaaccccggauucgcucuggcagccgcugccauagcgugguugcucggcaguuccacuucucagaaagucaucuaucuggugaugauucugcucaucgccccugcauacagcauuaggugcaucggcguauccaaucgggauuuuguugaagggaugucaggagguaccuggguggacgucguguuagagcauggcgggugugugacagucauggcucaggauaagccagccguugacauagagcuggugaccacgacuguaaguaacauggcagaagugcguagcuacugcuaugaggcuucuauuuccgauauggccucagacagccgcugucccacacaaggagaagcguaccuugacaaacagagugauacccaguaugucugcaagagaacuuugguggacaggggcugggguaauggguguggacuguucggcaaaggcucucuaguuacaugcgccaaguuugcaugcuccaagaaaaugaccgggaaaagcauccagccugagaaccucgaauaccggauuaugcugucggugcacggaucucaacacuccgguaugaucgucaaugauacgggccaugagaccgacgagaaccgagcuaaaguggaaaucacaccaaauucaccccgcgccgaggcuacucuugggggauucggcagucuggguuuggauugugaaccuagaaccgggcucgacuuuagcgaucuguauuacuuaacaaugaacaauaagcacuggcugguacauaaagagugguuccacgacauuccacucccguggcacgccggcgcagauacuggaacaccccauuggaacaauaaggaagcccuuguugaguuuaaagacgcucacgcgaagaggcagaccguggucgugcugggcucccaggagggggcaguccauaccgccuuggcuggagcccuagaagcagagauggauggugccaagggccggcugucuagcgggcaccucaaaugccgccugaagauggacaaacuuagacugaagggagugucauauaguuuguguacugcugccuucacguuuacaaaaauaccugcagaaacccuccauggcacuguuaccguggagguacaguacgcggguacagacgggccaugcaagguccccgcucaaauggccguggauaugcagacccugacuccuguuggcagguuaaucacagcaaacccagugauuacggaauccaccgagaacagcaagaugaugcuggagcuagaucccccguucggagacucuuacaucgucauaggcgugggggaaaagaagauuacucaccacuggcaucguucaggaaguacaaucgguaaagccuuugaggcuaccguacggggcgccaagcgaauggcagugcucggggacacagcuugggauuucggaagcguuggcggugcccuuaauucccuggggaaaggcauccaccagauuuucggagcggccuuuaagucuuuguucggcgggaugucgugguuuagccaaauccugauuggaacucuccuggucuggcuuggccugaacaccaagaaugguuccauaucauugacgugucucgcuuuagggggagugcugaucuuccugaguaccgcagugucugccgacgucggcugcagcguugauuuuuccaaaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8417 - RNA, 2365 nt, Artificial Sequence
  KU681082.3 prME-long mRNA Design 3 opt
gggagaaagcuuaccaugagaaucauuaacgccaggaaggagaaaaagcggcgcggcgcugacaccagcguggggauagucggacugcuccuuacaacugcaauggccguugaagugacgcgacgugguuccgcguacuauauguaccuggauagaucugacgcuggcgaggccaucucauuccccaccacauuggggaugaauaaaugcuauauucagaucauggauuuaggacacaugugugacgcaacuaugaguuacgaaugcccuaugcuggaugagggcguagaaccagacgauguggacuguuggugcaacaccacaagcaccugggucguguaugguacuugucaucacaagaaaggggaggccaggcggucccgcagagcuguuacacuaccgucucauucgaccaggaagcuccaaacgcggucacagacuuggcuggagagccgcgaauacaccaagcaccuuauucgaguggagaauuggaucuuuagaaaccccggauucgcacuggccgcugccgucauagcgugguugcucggcaguuccacaucucagaaagugaucuaucugguaaugauucugcucaucgccccugcauacagcauuaggugcaucggcguuuccaaucgggauuuuguggaagggaugucaggagguacuugggucgacgugguguuagagcauggcgggugugucaccguuauggcucaggauaagccaacaguggacauagagcugguaaccacgacugugaguaacauggccgaaguccguagcuacugcuaugaggcaucuauuuccgauauggcuucagacagccgcugucccacacaaggagaagccuaccuugacaaacagagugauacccaguaugugugcaagagaacuuugguugacaggggcugggguaauggguguggacuguucggcaaaggcucucuagugacaugcgcgaaguuugccugcuccaagaaaaugaccgggaaaagcauccagccugagaaccucgaauaccggauuaugcugucgguccacggaucucaacacuccgguaugaucgugaaugauacgggccaugagaccgacgagaaccgagcaaaaguagaaaucacaccaaauucaccccgcgcugaggccacucuugggggauucggcagucuggguuuggauugugaaccuagaaccgggcucgacuuuagcgaucuguauuacuuaacaaugaacaauaagcacuggcugguucauaaagagugguuccacgacauuccacucccguggcacgcuggcgccgauacuggaacaccccauuggaacaauaaggaagcacuuguggaguuuaaagacgcccacgcuaagaggcagaccgucgugguccugggcucccaggagggggcggugcauaccgcauuggccggagcucuagaagccgagauggauggugcaaagggccggcugucuagcgggcaccucaaaugccgccugaagauggacaaacuuagacugaagggaguuucauauaguuuguguacugccgcuuucacguuuacaaaaauaccugccgaaacccuccauggcacugugaccguagagguccaguacgcagguacagacgggccaugcaaggugcccgcgcaaauggcuguugauaugcagacccugacuccugugggcagguuaaucacagccaacccagucauuacggaauccaccgagaacagcaagaugaugcuggagcuagaucccccguucggagacucuuacaucgugauaggcguaggggaaaagaagauuacucaccacuggcaucguucaggaaguacaaucgguaaagcauuugaggccaccgugcggggcgcuaagcgaauggccguucucggggacacagcaugggauuucggaagcgucggcggugcucuuaauucccuggggaaaggcauccaccagauuuucggagccgcguuuaagucuuuguucggcgggaugucgugguuuagccaaauccugauuggaacucuccugguguggcuuggccugaacaccaagaaugguuccauaucauugacgugucucgccuuagggggagugcugaucuuccugaguaccgcugucucugcagacguuggcugcagcguggauuuuuccaaaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8418 - RNA, 2365 nt, Artificial Sequence
  KX601167.1 prME-long mRNA Design 3 opt
gggagaaagcuuaccaugagaaucauuaacgccaggaaggagaaaaagcggcgcggcgcugacaccagcguggggauagucggacugcuccuuacaacugcaauggccguugaagugacgcgacgugguuccgcguacuauauguaccuggauagaucugacgcuggcgaggccaucucauuccccaccacauuggggguaaauaaaugcuauauucagaucauggauuuaggacacaugugugacgcaacuaugaguuacgaaugcccuaugcuggaugagggcguggaaccagacgaugucgacuguuggugcaacaccacaagcaccugggugguuuaugguacuugucaucacaagaaaggggaggccaggcggucccgcagagcugugacacuaccgucucauucgaccaggaagcuccaaacgcggucacagacuuggcuggagagccgcgaauacaccaagcaccuuauucgagucgagaauuggaucuuuagaaaccccggauucgcacuggccgcugccgcgauagcaugguugcucggcaguuccacaucucagaaagugaucuaucugguaaugauucugcucaucgccccugcuuacagcauuaggugcaucggcguuuccaaucgggauuuuguggaagggaugucaggagguacuugggucgacgugguguuagagcauggcgggugugucaccguuauggcccaggauaagccaacaguggacauagagcugguaaccacgacugugaguaacauggcagaaguccguagcuacugcuaugaggcuucuauuuccgauauggccucagacagccgcugucccacacaaggagaagcguaccuugacaaacagagugauacccaguaugugugcaagagaacuuugguugacaggggcugggguaauggguguggacuguucggcaaaggcucucuagugacaugcgccaaguuugcaugcuccaagaaaaugaccgggaaguccauccagccugagaaccucgaauaccggauuaugcugucgguccacggaucucaacacuccgguaugaucgugaaugauacgggccaugagaccgacgagaaccgagcuaaaguagaaaucacaccaaauucaccccgcgccgaggcuacucuugggggauucggcagucuggguuuggauugugaaccuagaaccgggcucgacuuuagcgaucuguauuacuuaacaaugaacaauaagcacuggcugguucauaaagagugguuccacgacauuccacucccguggcacgccggcgcagauacuggaacaccccauuggaacaauaaggaagcccuuguggaguuuaaagacgcucacgcgaagaggcagaccgucgugguccugggcucccaggagggggcagugcauaccgccuuggcuggagcccuagaagcagagauggauggugccaagggccggcugucuagcgggcaccucaaaugccgccugaagauggacaaacuuagacugaagggaguuucauauaguuuguguacugcugccuucacguuuacaaaaauaccugcagaaacccuccauggcacugugaccguagagguccaguacgcggguacagacgggccaugcaaggugcccgcucaaauggccguugauaugcagacccugacuccugugggcagguuaaucacagcaaacccagucauuacggaauccaccgagaacagcaagaugaugcuggagcuagaucccccguucggagacucuuacaucgugauaggcguaggggacaaaaagauuacucaccacugguaucguucaggaaguacaaucgguaaagccuuugaagcuaccgugcggggcgccaagcgaauggcaguucucggggauacagcuugggacuucggaagcgucggcggugcccugaauagccuugggaaaggcauccaucagauuuucggagcggccuuuaagucuuuguucggcgggaugucgugguuuagccaaauccugauuggaacucuccugguguggcuuggccugaacaccaagaaugguuccauaucauugacgugucucgcuuuagggggagugcugaucuuccugaguaccgcagucucugccgauguuggcugcagcguggacuuuuccaaaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8419 - RNA, 2365 nt, Artificial Sequence
  KX694533.2 prME-long mRNA Design 3 opt
gggagaaagcuuaccaugagaaucauuaacgccaggaaggagaaaaagcggcgcggcgcugacaccagcguggggauagucggacugcuccuuacaacugcaauggccguugaagugacgcgacgugguuccgcguacuauauguaccuggauagaucugacgcuggcaaagccaucucauuccccaccacauuggggguaaauaagugcuauauucagaucauggauuuaggacacaugugugacgcaacuaugaguuacgagugcccuaugcuggaugaaggcguggagccagacgaugucgacuguuggugcaacaccacaagcaccugggugguuuaugguacuugucaucacaaaaagggggaagccaggcggucccgcagagcugugacacuaccgucucauucgaccaggaagcuccaaacgcggucacagacuuggcuggagagccgcgaguacaccaaacaccuuauucgagucgaaaauuggaucuuuagaaaccccggauucgcacuggccgcugccgcgauagcaugguugcucggcaguuccacaucucagaaggugaucuaucugguaaugauucugcucaucgccccugcuuacagcauuaggugcaucggcguuuccaaucgggauuuuguggaggggaugucaggagguacuugggucgacgugguguuagaacauggcgggugugucaccguuauggcccaggauaaaccaacaguggacauagagcugguaaccacgacugugaguaacauggcagagguccguagcuacugcuaugaggcuucuauuuccgauauggccucagacagccgcugucccacacaaggagaagcguaccuugacaagcagagugauacccaguaugugugcaaaagaacuuugguugacaggggcugggguaauggguguggacuguucggcaagggcucucuagugacaugcgccaaguuugcaugcuccaaaaagaugaccgggaaaagcauccagccugaaaaccucgaguaccggauuaugcugucgguccacggaucucaacacuccgguaugaucgugaaugauaucggccaugaaacggacgagaaccgagcuaagguagagauuaccccaaauucaccccgcgccgaagcuacacuugggggauucggcagucuggguuuggauugugagccuagaacugggcucgacuuuagcgaucuguauuacuuaaccaugaacaauaaacacuggcugguucauaaggaaugguuccacgacauaccacucccguggcacgccggcgcagauacaggaacuccccauuggaacaauaaagaggcccuuguggaauuuaaggacgcucacgcgaagaggcagaccgucgugguccugggcucccaggagggggcagugcauacagccuuggcuggagcccuagaggcagaaauggauggugccaaaggccggcugucuagcgggcaccucaagugccgccugaaaauggacaagcugagacugaaaggaguuucauauaguuuguguaccgcugccuucacuuuuacgaagaucccugcagagacacuccauggcaccgugacuguagaaguccaguacgcggguaccgacgggccaugcaaggugcccgcucaaauggccguugauaugcagacacugaccccugugggcagguuaauuacugcaaacccagucaucacagaguccacggaaaacagcaaaaugaugcuggagcuagaucccccguucggagacucuuacauagugauuggcguaggggacaagaaaaucacccaccacuggcaucguucaggaaguacuaucgguaaggccuuugaggcuacagugcggggcgccaaacgaauggcaguucucggggauaccgcuugggacuucggaagcgucggcggugcccuuaauucccuugggaagggcauucaccagaucuucggagcggccuuuaagucuuuguucggcgggaugucgugguuuagccaaauucugauaggaacacuccugguguggcuuggccugaacacuaaaaaugguuccaucucauugaccugucucgcuuuagggggagugcugauuuuccugaguacggcagucucugccgauguuggcugcagcguggacuuuuccaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8420 - RNA, 2365 nt, Artificial Sequence
  KY288905.1 prME-long mRNA Design 3 opt
gggagaaagcuuaccaugagaaucauuaacgccaggaaggagcggaaacgccgaggcgcugacaccagcauagggaucgugggacugcuccuuacaacugcaauggccgcggaaauuacgcguagagguuccgcuuacuauauguaccuggauaggucugacgccggcaaggcaaucucauucgccaccacauugggggucaauaaaugccacguucagauuauggauuuaggacauaugugugacgcuacuaugaguuaugagugccccaugcuggaugaaggcguggagccugacgauguagacuguuggugcaacaccacaagcaccuggguggucuacgguacuugucaccauaagaaaggggaagcacggcgcuccagaagggccgugacacuaccaucucacucgacccggaagcuccaaacgcgcucacagacuuggcuggagagccgagaguauaccaagcaucuuaucaaaguugaaaauuggauauuuagaaacccgggauucacacugguggcugucgccaucgcgugguugcucggcaguuccacuucucagaaggugauuuaccugguaaugauccugcucauugcacccgccuauagcaucaggugcauaggcguuuccaaucgggauuuuguggaggggaugucaggagguaccugggucgacgugguguuagaacacggcgggugugucacaguuauggcucaggauaaaccuaccguggacauugagcugguaacgacuacagugaguaacauggccgagguccguagcuacugcuacgaagcaucuaucuccgauauggcuucagacagccgcuguccaacccaaggagaggccuaucuugacaagcagagugauacucaguacgugugcaaaagaacauugguugacaggggcugggguaauggguguggacuguucggcaagggcucucuagugaccugcgcgaaguuuacgugcuccaaaaagaugaccgggaaaagcauucagcccgaaaaccucgaguaucggaucaugcugucgguccacggaucucaacauuccgguaugaucgugaaugauacaggccacgaaacugacgagaaccgagccaagguagagguuaccccuaauucaccacgcgcagaagcuacacuugggggauucggcagucuggguuuggauugugagcccagaacugggcucgacuuuagcgaucuguacuauuuaaccaugaacaauaaacauuggcuggugcacaaggaaugguuccacgacauuccucucccauggcaugccggcgcugauacaggaaccccgcacuggaacaauaaagaggcccuugucgaauuuaaggacgcacaugccaagaggcagacuguggucgugcugggcucccaggagggggcuguucacacggcguuggcaggagcccuagaggcugaaauggauggugccaaaggccggcuguucucugggcaucucaagugccgccugaaaauggacaaacuuagacugaagggagugagcuacucauuguguacagcagccuuuaccuucacuaagguacccgcugagacccuccacggcacagucaccguggaaguucaguaugccgguacugacgggccuugcaaggugccagcacaaauggcggucgauaugcagacacugacgcccgugggcagguuaauaaccgcuaacccuguaaucacugagaguacagaaaacuccaaaaugaugcuggagcuagacccacccuuuggagauagcuacauugugaucggcguuggggacaagaaaauaacccaccauuggcaccguucuggaucaacaauugguaaggccuucgaggcaacuguccggggcgccaaacgaauggcugugcucggggauaccgccugggacuucggaagugugggcggugucuuuaauagccuggggaagggcauccaucagaucuucggagcagcuuuuaagucccuuuucggcgggaugucuugguuuucgcaaauuuugaucggaacgcugcucguuuggcugggccuuaacaccaaaaaugguagcauuucccugacauguuuggcccucgggggagugaugauauuccugucaacugcggugagugccgauguaggcugcucugucgacuuuagcaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8421 - RNA, 2365 nt, Artificial Sequence
  KF268950.1 prME-long mRNA Design 3 opt
gggagaaagcuuaccaugagaaucauuaacgccaggaaggagcggaaacgccgaggcgcugacaccagcauagggaucauuggacugcuccuuacaacugcaauggccgcggaaaucacgcguagagguuccgcuuacuauauguaccuggauaggucugacgccggcaaggcaauuucauucgccaccaauuugggggugaacaaaugccacguccagaucauggauuuaggacauaugugugacgcuacaaugaguuaugagugccccaugcuggaugaaggcguugagccugacgauguggacuguuggugcaauacuaccagcacauggguaguguacgguaccugucaccauaagaaaggggaagcacggcgcuccagaagggccgucacucuaccaucucacucgacacggaagcuccaaacccgcucacagacguggcuggagagccgagaguauacuaagcaucuuauaaaaguggaaaacuggaucuuuagaaauccgggauucgcucuggccgcgguugcaauugccugguugcucggcaguuccaccucucagaaggugaucuaccuggucaugauucugcucaucgcucccgccuauagcauaaggugcauuggcguguccaaccgggauuuuguagaggggaugucaggagguacauggguugacguggucuuagaacacggcgggugugugacugugauggcacaggauaaaccuaccgucgacaucgagcugguuacaaccacggugaguaauauggcugagguacguagcuacugcuacgaagccucuauuuccgauauggcgucagacagccgcuguccaacucaaggagaggccuaucuugacaagcagagugauacacaguacgugugcaaaagaaccuuggucgacaggggcugggguaacggguguggacuguucggcaagggcucucuagugacuugcgcaaaguuuacaugcuccaaaaagaugaccgggaaaagcauccagcccgaaaaucucgaguaucggaucaugcugucgguucacggaucucaacauuccgguaugauugugaacgauauaggccacgaaacggacgagaaucgagcuaaggucgaggugaccccuaacucaccacgcgccgaagcuacacuugggggauucggcagucuggguuuggauugugagcccagaacugggcucgacuuuagcgaucuguacuauuuaaccaugaauaacaaacauuggcugguacacaaggaaugguuccacgacaucccucucccauggcaugccggcgcagauacaggaacuccgcacuggaauaacaaagaggcccuuguugaauuuaaggacgcucaugcgaagaggcagaccguggucgugcugggcucccaggagggggcaguccacacagccuuggcuggagcccuagaggcagaaauggauggugccaaaggccggcuguucucugggcaucucaagugccgccugaaaauggacaaacuuagacugaagggagugagcuacucauuguguaccgcugccuuuacuuucacgaagguucccgcagagacacuccacggcaccgugacuguagaaguccaguaugcggguaccgacgggccuugcaaggugccagcucaaauggccguugauaugcagacacugacccccgugggcagguuaauuacugcaaacccugucaucacagagaguacggaaaauuccaaaaugaugcuggagcuagacccacccuuuggagauagcuacauagugauuggcguaggggacaagaaaaucacccaccauuggcaccguucuggaucaacuaucgguaaggccuucgaggcuacagugcggggcgccaaacgaauggcaguucucggggauaccgcuugggacuucggaagugucggcgguguguuuaacagccuggggaagggcgugcaucagauuuucggagccgcguuuaagucccuuuucggcgggaugucuugguuuucgcaaaucuugauuggaacacugcucgucuggcugggccuuaauacuaaaaacgguagcauaucccugaccuguuuggcccucgggggaguuaugaucuuccugucaacggcugugagugcagaugugggcugcucuguagacuuuagcaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8422 - RNA, 2365 nt, Artificial Sequence
  KF383121.1 prME-long mRNA Design 3 opt
gggagaaagcuuaccaugagaaucauuaacgccaggaaggagcggaaacgccgaggcgcugacaccagcauagggaucauuggacugcuccuuacaacugcaauggccgcggaaaucacgcguagagguuccgcuuacuauauguaccuggauaggucugacgccggcaaggcaauuucauucgccaccacauugggggugaauaaaugccacguccagaucauggauuuaggacauaugugugacgcuacuaugaguuaugagugccccaugcuggaugaaggcguugagccugacgauguggacuguuggugcaacaccacaagcaccuggguaguguacgguacuugucaccauaagaaaggggaagcacggcgcuccagaagggccgucacacuaccaucucacucgacccggaagcuccaaacgcgcucacagacuuggcuggagagccgagaguauaccaagcaucuuauaaaaguggaaaauuggaucuuuagaaacccgggauucgcucugguugccguggcgauugcaugguugcucggcaguuccacaucucagaaggucaucuaccuggugaugauucugcucaucgcccccgcuuauagcauaaggugcauuggcguauccaaucgggauuuuguugaggggaugucaggagguacuuggguggacgucguguuagaacacggcgggugugugaccgucauggcccaggauaaaccuacaguugacaucgagcuggugaccacgacuguaaguaacauggcagaggugcguagcuacugcuacgaggcuucuauuuccgauauggccucagacagccgcuguccaacacaaggagaagcguaucuugacaagcagagugauacccaguacgucugcaaaagaacuuugguggacaggggcugggguaauggguguggacuguucggcaagggcucucuaguuacaugcgccaaguuuaccugcuccaaaaagaugacggggaaaagcauccagcccgaaaaccucgaguaucggaucaugcugucggugcacggaucucaacauuccgguaugauugucaaugauauaggccacgaaaccgacgagaaccgagcaaagguggagguaacaccuaauucaccacgcgcugaagccacucuugggggauucggcagucuggguuuggauugugagcccagaaccgggcucgacuuuagcgaucuguacuauuuaacaaugaacaauaaacauuggcugguucacaaggaaugguuccacgacaucccucucccauggcaugcuggcgccgauacuggaaccccgcacuggaacaauaaagaggcacuuguggaauuuaaggacgcccaugcuaagaggcagacagucgugguccugggcucccaggagggggcggugcacaccgcauuggccggagcucuagaggccgaaauggauggugcaaaaggccggcuguucucugggcaucucaagugccgccugaaaauggacaaacuuagacugaagggaguuagcuacucauuguguacugccgcuuuuacguucacaaaggugcccgccgagacccuccacggcacuguaaccgucgaagugcaguaugcagguacagacgggccuugcaagguuccagcgcaaauggcuguggauaugcagacccugacucccgucggcagguuaauuacagccaacccugugaucacggagaguaccgaaaacuccaaaaugaugcuggagcuagacccacccuuuggagauagcuacauaguaauuggcgugggggacaagaaaaucacucaccauuggcaccguucuggaucaacaaucgguaaggcauucgaggccaccguucggggcgcuaaacgaauggccguccucggggauacagcaugggacuucggaagugugggcgguguguuuaauagccuggggaagggcauucaucagaucuucggagcugccuuuaagucccuuuucggcgggaugucuugguuuucgcaaauuuugauaggaacucugcucgucuggcugggccuuaacaccaaaaaugguagcaucucccugacguguuuggcgcucgggggaguuaugauuuuccugucaaccgccgugagugcugaugugggcugcucuguagacuuuagcaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8423 - RNA, 2347 nt, Artificial Sequence
  KF268949.1 prME-long mRNA Design 3 opt
gggagaaagcuuaccaugagaaucauuaacgccaggaaggagcggaaacgccgaggcgcugacaccagcauagggaucauuggacugcuccuuacaacugcaauggccgcggaaaucacgcguagagguuccgcuuacuauauguaccuggauaggucugacgccggcaaggcaauuucauucgccaccaauuugggggugaacaaaugccacguccagaucauggauuuaggacauaugugugacgcuacaaugaguuaugagugccccaugcuggaugaaggcguugagccugacgauguggacuguuggugcaauacuaccagcacauggguaguguacgguaccugucaccauaagaaaggggaagcacggcgcuccagaagggccgucacucuaccaucucacucgacacggaagcuccaaacccgcucacagacguggcuggagagccgagaguauacuaagcaucuuauaaaaguggaaaacuggaucuuuagaaauccgggauucgcucuggccgcgguugcaauugccugguugcucggcaguuccaccucucagaaggugaucuaccuggucaugauucugcucaucgcucccgccuauagcauaaggugcauuggcguguccaaccgggauuuuguagaggggaugucaggagguacauggguugacguggucuuagaacacggcgggugugugacugugauggcacaggauaaaccuaccgucgacaucgagcugguuacaaccacggugaguaauauggcugagguacguagcuacugcuacgaagccucuauuuccgauauggcgucagacagccgcuguccaacucaaggagaggccuaucuugacaagcagagugauacacaguacgugugcaaaagaaccuuggucgacaggggcugggguaacggguguggacuguucggcaagggcucucuagugacuugcgcaaaguuuacaugcuccaaaaagaugaccgggaaaagcauccagcccgaaaaucucgaguaucggaucaugcugucgguucacggaucucaacauuccgguaugauugugaacgaugaaaaucgagcuaaggucgaggugacgccuaacucaccacgcgccgaggcuacccuuggcggguucggaagucugggcuuggacugugaacccagaacaggucucgauuuuagcgaccuguacuauuuaacuaugaauaacaaacacuggcugguacauaaggagugguuccacgauauaccucucccauggcacgccggggcagacaccggcacaccgcauuggaauaacaaagaagcccuuguugaguuuaaggaugcucacgcgaagaggcagacuguggucgugcugggaucccaggaaggcgcaguccauaccgccuuggcuggggcccuagaggcagagauggacggagccaaaggucggcuguucucuggccaccucaagugccgccugaaaauggauaaacuuagacugaaaggggugagcuacucauuguguacagcugccuuuaccuucacuaagguucccgcagaaacgcuccauggaacagugaccguagagguccaguaugcgggcacugacgguccuugcaaggugccagcucaaauggccguugacaugcagacccugacacccguggggagguuaaucaccgcaaacccugucauuacugaaaguacagaaaauuccaaaaugaugcuggagcuagauccacccuuuggcgacagcuacaucgugauaggaguaggcgauaagaaaauuacgcaccacuggcaucguucugggucaaccaucggaaaggccuucgaggcuacugugcggggugccaaacgaauggcaguucucggcgacacagcuugggauuucgggagugucggaggcguguuuaacagccuggguaaggggauccaccagauuuucggcgccgcguuuaagucccuuuucggaggcaugucuugguuuucgcaaaucuugauugggacccugcucguguggcugggacuuaauacaaagaacggcagcauaucccugacuuguuuggcccucgguggggucaugaucuuccugucaaccgcuguuagugcagacgugggaugcucuguggauuuuagcaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8424 - RNA, 2365 nt, Artificial Sequence
  KU955595.1 prME-long mRNA Design 3 opt
gggagaaagcuuaccaugagaaucauuaacgccaggaaggagcggaaacgccgaggcgcugacaccagcauagggaucgugggacugcuccuuacaacugcaauggccgcggaaauuacgcguagagguuccgcuuacuauauguaccuggauaggucugacgccggcaaggcaaucucauucgccaccacauugggggucaauaaaugccacguucagauuauggauuuaggacauaugugugacgcuacuaugaguuaugagugccccaugcuggaugaaggcguggagccugacgauguagacuguuggugcaacaccacaagcaccuggguggucuacgguacuugucaccauaagaaaggggaagcacggcgcuccagaagggccgugacacuaccaucucacucgacccggaagcuccaaacgcgcucacagacuuggcuggagagccgagaguauaccaagcaucuuaucaaaguugaaaauuggauauuuagaaacccgggauucgcucugguggccgucgcgaucgcaugguugcucggcaguuccacaucucagaaggugauuuaccugguaaugauccugcucauugcccccgcuuauagcaucaggugcauaggcguuuccaaucgggauuuuguggaggggaugucaggagguacuugggucgacgugguguuagaacacggcgggugugucaccguuauggcccaggauaaaccuacaguggacauugagcugguaaccacgacugugaguaacauggcagagguccguagcuacugcuacgaggcuucuaucuccgauauggccucagacagccgcuguccaacacaaggagaagcguaucuugacaagcagagugauacccaguacgugugcaaaagaacuuugguugacaggggcugggguaauggguguggacuguucggcaagggcucucuagugacaugcgccaaguuuaccugcuccaaaaagaugacggggaaaagcauucagcccgaaaaccucgaguaucggaucaugcugucgguccacggaucucaacauuccgguaugaucgugaaugauaccggccacgaaacagacgagaaccgagcaaagguagagguuacuccuaauucaccacgcgcugaagccacccuugggggauucggcagucuggguuuggauugugagcccagaacagggcucgacuuuagcgaucuguacuauuuaacuaugaacaauaaacauuggcuggugcacaaggaaugguuccacgacauuccucucccauggcaugcuggcgccgauaccggaacaccgcacuggaacaauaaagaggcacuugucgaauuuaaggacgcccaugcuaagaggcagaccguggucgugcugggcucccaggagggggcgguucacacugcauuggccggagcucuagaggccgaaauggauggugcaaaaggccggcuguucucugggcaucucaagugccgccugaaaauggacaaacuuagacugaagggagugagcuacucauuguguacggccgcuuuuacauucaccaagguacccgccgagacucuccacggcaccgucacaguggaaguucaguaugcagguaccgacgggccuugcaaggugccagcgcaaauggcugucgauaugcagacucugacacccgugggcagguuaauaacggccaacccuguaaucaccgagaguacugaaaacuccaaaaugaugcuggagcuagacccacccuuuggagauagcuacauugugaucggcguuggggacaagaaaauaacacaccauuggcaccguucuggaucaaccauugguaaggcauucgaggccacaguccggggcgcuaaacgaauggccgugcucggggauacugcaugggacuucggaagugugggcggugucuuuaauagccuggggaagggcauccaucagaucuucggagcugccuuuaagucccuuuucggcgggaugucuugguuuucgcaaauuuugaucggaacccugcucguuuggcugggccuuaacacgaaaaaugguagcauuucccugaccuguuuggcgcucgggggagugaugauauuccugucaacagccgugagugcugauguaggcugcucugucgacuuuagcaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8425 - RNA, 2365 nt, Artificial Sequence
  KF383116.1 prME-long mRNA Design 3 opt
gggagaaagcuuaccaugagaaucauuaacgccaggaaggagcggaaacgccgaggcgcugacaccagcauagggaucgugggacugcuccuuacaacugcaauggccgcggaaauuacgcguagagguuccgcuuacuauauguaccuggauaggucugacgccggcaaggcaaucucauucgccaccacauugggggucaauaaaugccacguucagauuauggauuuaggacauaugugugacgcuacuaugaguuaugagugccccaugcuggaugaaggcguggagccugacgauguagacuguuggugcaacaccacaagcaccuggguggucuacgguacuugucaacacaagaaaggggaagcacggcgcuccagaagggccgugacacuaccaucucauucgacccggaagcuccagacgcgcucacagacuuggcuggagagccgagaguauaccaagcaccuuaucaaaguugaaaauuggauauuuagaaacccgggauucgcucugguggccgucgcgaucgcaugguugcucggcaguuccacaucucagaaggugauuuaccugguaaugauccugcucauugcccccgcuuauagcaucaggugcauaggcguuuccaaucgggauuuuguggaggggaugucaggagguacuugggucgacgugguguuagaacauggcgggugugucaccguuauggcccaagauaaaccuacaguggacauugagcugguaaccacgacugugaguaacauggcagagguccguagcuacugcuacgaggcuucuaucuccgauauggccucagacagccgcuguccaacacagggagaagcguaucuugacaagcagagugauacccaguacgugugcaaaagaacuuugguugacaggggcugggguaauggguguggacuguucggcaagggcucucuagugacaugcgccaaguuuaccugcuccaaaaagaugacggggaaaagcauucaacccgaaaaccucgaguaucggaucaugcugucgguccacggaucucagcacuccgguaugaucgugaaugauauuggccaugaaaccgacgagaaccgagcaaagguagagguuacaccuaauucaccacgcgcugaagccacucuugggggauucggcagucuggguuuggauugugagcccagaaccgggcucgacuuuagcgaucuguacuauuuaacaaugaacaauaaacacuggcuggugcauaaggaaugguuccacgacauaccucucccauggcacgcuggcgccgauacuggaaccccgcauuggaacaauaaagaggcacuugucgaauuuaaggacgcccacgcuaagaggcagacaguggucgugcugggcucccaggagggggcgguucauaccgcauuggccggagcucuagaggccgaaauggauggugcaaaaggccggcuguucucugggcaccucaagugccgccugaaaauggacaaacuuagacugaagggagugagcuacucauuguguacugccguaugcacggcugccaagguccccgcagagacacuccauggcaccgugacuguugaagugcaauaugcggguaccgacgggccuuguaaggucccagcucagauggccguggauaugcagacacugacccccguaggcagguuaaucacugcaaacccugugauuacagagaguacggaaaacuccaaaaugaugcuggagcuagacccacccuuuggagauagcuacaucguuauaggcgucggggacaagaaaauuacccaccacuggcaucguucuggaucaacuaucgguaaggccuucgaggcuacagugcggggcgccaaacgaauggcagugcucggggauaccgcuugggacuuuggaagugucggcgguguuuucaauagccuggggaagggcauccaccaaauuuucggagccgcguuuaagucccuuuucggcgggaugucuugguuuucgcagaucuugauuggaacacugcucguguggcugggccuuaacacuaaaaaugguagcauaucccugaccugcuuggcccucgggggagugaugaucuuccugucaacggcuguaagugcagaugucggcuguucuguggacuuuagcaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8426 - RNA, 2347 nt, Artificial Sequence
  KU963574.2 prME-long mRNA Design 3 opt
gggagaaagcuuaccaugagaaucauuaacgccaggaaggagcggaaacgccgaggcgcugacgcaagcauagggaucgugucccugcuccuuaccacagucauggccgcggaaauuacucguagaggaucugcuuacuauauguaccuggauaggucagacgccgguaaggcaaucaguuucguuacgaccuugggcgugaauaaaugccacguacagauuauggauuuagggcauaugugugacgccacaaugagcuaugagugccccaugcuggaugaaggaguggagccugacgaugucgacuguuggugcaacacuaccuccacaugggugguuuacggcaccugucaccauaagaaaggugaagcucggcgcucuagaagggcagugacucuaccaucgcacucaacacggaagcuccaaacccgcagccagacguggcuggagagucgagaguauacuaagcaucuuaucaaagucgaaaauuggauauuuagaaacccgggguucgcccugguggcuguagccaucgcgugguugcucggauccucuaccagccagaagguuauuuaccuggugaugauccugcucauugcacccgccuauuccaucaggugcauaggcgucucaaaucgggauuuuguggagggcaugagugggggaacauggguggacgucguuuuagaacacgguggcugugugacuguaauggcucaggauaaaccuaccguggacauugagcuggucacaaccacggugagcaacauggccgagguucguucuuacugcuacgaagcauccaucucagauauggcuagcgacagucgcuguccaacucaaggggaggccuaucuugacaagcagucugauacacaguacgugugcaaaagaaccuuggucgacaggggauggggcaaugguugugggcuguucggaaagggcucccuagugacuugcgcgaaguuuacaugcagcaaaaagaugaccggcaaaucgauucagcccgaaaaccucgaguaucggaucaugcugucuguacacgggucccaacauucaggaaugaucguuaaugaugaaaaccgagccaagguggaggucacgccuaauaguccacgcgcagaggcuacccuugguggcuucgggagccugggauuggacugugaacccagaacaggccucgauuuuuccgaccuguacuauuuaacuaugaacaauaaacacuggcuggugcauaaggagugguuccacgauauuccucucccauggcacucuggugccgacaccgaaacaccgcauuggaacaauaaagaggcucuugucgaauuuaaggaugcccacgcaaagaggcagacugugguugugcuggggagccaggagggcgccguacauaccgcuuuggcgggagcacuagaggccgaaauggacggcgcuaaagggcggcugucaaguggacaccucaagugccgccugaaaauggauaaacuuagacugaaaggugucuccuacagcuuguguacagccgcauucaccuuuacuaaggugcccgccgagacgcuccauggcacaguuaccguggaaguccaguaugcugggagggacggaccuugcaaggugccagcccaaauggcaguagacaugcagacucugacccccgugggccguuuaauaacagcgaacccuguuaucaccgagucuacugaaaacucaaaaaugaugcuggagcuagauccacccuucggugacaguuacauugucaucggggugggcgauaagaaaauaacacaccacuggcaucggagcggauccauuaucggcaaggcuuuugaggccacggugcgaggggcaaaaagaauggccguccucggagacaccgcuugggauuucgguucuguuggcgggguguucaauucgcugggaaagggcauccaccagauuuuuggugccgcauucaagagccuuuuugggggcauguccugguucucacaaaucuugauuggaacucugcucguguggcugggccuuaacacaaagaaugggaguauaucucugaccuguuuggcucucggaggcguaaugaucuuucugagcacagccgucuccgcggacguggguugcucaguugauuucagcaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8427 - RNA, 2347 nt, Artificial Sequence
  KX601166.1 prME-long mRNA Design 3 opt
gggagaaagcuuaccaugagaaucauuaacgccaggaaggagcggaaacgccgaggcgcugacaccagcauagggaucgugggacugcuccuuacaacugcaauggccgcggaaauuacgcguagagguuccgcuuacuauauguaccuggauaggucugacgccggcaaggcaaucucauucgccaccacauugggggucaauaaaugccacguucagauuauggauuuaggacauaugugugacgcuacuaugaguuaugagugccccaugcuggaugaaggcguggagccugacgauguagacuguuggugcaacaccacaagcaccuggguggucuacgguacuugucaccauaagaaaggggaagcacggcgcuccagaagggccgugacacuaccaucucacucgacccggaagcuccaaacgcgcucacagacuuggcuggagagccgagaguauaccaagcaucuuaucaaaguugaaaauuggauauuuagaaacccgggauucgcucugguggccgucgcgaucgcaugguugcucggcaguuccacaucucagaaggugauuuaccugguaaugauccugcucauugcccccgcuuauagcaucaggugcauaggcguuuccaaucgggauuuuguggaggggaugucaggagguacuugggucgacgugguguuagaacacggcgggugugucaccguuauggcccaggauaaaccuacaguggacauugagcugguaaccacgacugugaguaacauggcagagguccguagcuacugcuacgaggcuucuaucuccgauauggccucagacagccgcuguccaacacaaggagaagcguaucuugacaagcagagugauacccaguacgugugcaaaagaacuuugguugacaggggcugggguaauggguguggacuguucggcaagggcucucuagugacaugcgccaaguuuaccugcuccaaaaagaugacggggaaaagcauucagcccgaaaaccucgaguaucggaucaugcugucgguccacggaucucaacauuccgguaugaucgugaaugaugaaaaccgagcaaagguagagguuaccccuaauucaccacgcgcugaggccacacuuggcggguucggaagucugggcuuggacugugaacccagaacuggucucgauuuuagcgaccuguacuauuuaaccaugaacaauaaacacuggcuggugcauaaggagugguuccacgauauuccucucccauggcacgcuggggccgacacaggcacuccgcauuggaacaauaaagaagcacuugucgaguuuaaggaugcccacgcuaagaggcagaccguggucgugcugggaucccaggaaggcgcgguucauacagcauuggccggggcucuagaggccgagauggacggagcaaaaggucggcuguucucuggccaccucaagugccgccugaaaauggauaaacuuagacugaagggggugagcuacucauuguguaccgccgcuuuuacuuucacgaagguacccgccgaaacacuccauggaaccgucacuguggagguucaguaugcaggcaccgacgguccuugcaaggugccagcgcaaauggcugucgacaugcagacacugacccccguggggagguuaauaacugccaacccuguaaucacagaaaguacggagaacuccaaaaugaugcuggaacuagauccacccuuuggcgacagcuacauugugaucggaguuggcgauaagaaaauaacccaccacuggcaucguucugggucaacuauuggaaaggcauucgaggccacaguccggggugcuaaacgaauggccgugcucggcgacaccgcaugggauuucgggagugugggaggcgucuuuaauagccuggguaaggggauccaccagaucuucggcgcugccuuuaagucccuuuucggaggcaugucuugguuuucgcaaauuuugaucgggacacugcucguuuggcugggacuuaacacuaaaaauggcagcauuucccugaccuguuuggcgcucgguggggugaugauauuccugucaacggccgugagugcugacguaggaugcucugucgauuuuagcaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8428 - RNA, 2365 nt, Artificial Sequence
  KF383118.1 prME-long mRNA Design 3 opt
gggagaaagcuuaccaugagaaucauuaacgccaggaaggagcggaaacgccgaggcgcugacaccagcauagggaucauuggacugcuccuuacaacugcaauggccgcggaaaucacgcguagagguuccgcuuacuauauguaccuggauaggucugacgccggcaaggcaauuucauucgccaccacauugggggugaauaaaugccacguccagaucauggauuuaggacauaugugugacgcuacuaugaguuaugagugccccaugcuggaugaaggcguugagccugacgauguggacuguuggugcaacaccacaagcaccuggguaguguacgguacuugucaccauaagaaaggggaaacacggcgcuccagaaggucugucucgcuacgguaucacuacacccgcaagcuccaaacgcgaucacagacuuggcuggagagcagagaguauaagaaacaucuuauaaugguggaaaauuggaucuuuaggaacccaggauucgcaauuguuaguguggccaucaccuggcugaugggcuccuugacaucucagaaggucauuuaccucgugaugaucguacugauaguuccggcuuacagcauuuccugcaucggcgugucaaaucgggaucuggucgaggggaugaguggagguacuuggguggacgugguccucgaacacggcggguguguuaccgagauggcccaggauaaacccacaguggacauugaguuaguaaccaugacggugagcaacauggcggaaguccguucuuauugcuacgaggcaucccugucagauauggccagcgcuagucgcuguccuacucaaggagaaccaucucuugacaagcaguccgacacacagagcgugugcaaaagaaccuugggcgauagggguugggggaauggauguggcaucuuuggcaaggggucgcugguuacuugcucuaaguucacaugcuguaaaaagaugcccggaaaauccauccagccugagaaccuagaauaucggauuaugcucccagugcacgguucacaacauaguggcaugauagucaaugacaucgggcacgagaccgaugagaaccgagccaagguggaaguaacgcccaauagcccucgcgcagaggcuacccugggaggcuuugguucccuugggcuggacugcgaaccaagaacaggcuuggauuucucugaccucuacuaucugacuaugaacaauaaacauugguuaguucacaaggagugguuucacgauauuccgcugcccuggcaugccggagcggacaccggcacaccucacuggaacaauaaagaagcccucguggaguucaaggaugcacaugcuaagaggcagacugucgugguccuugggagccaggagggagccgugcacaccgcucuggccggugcauuggaagccgagauggacggcgcuaaagggcggcuauuuucaggacaucugaagugucgccucaaaauggauaagcugagacuuaaaggcguuaguuacucccugugcacagcggcauucaccuuuacuaaggugccagccgaaacguugcacgguacaguaaccgucgaggugcagagcgcugggacugacggccccuguaagguuccugcccaaauggcaguggacaugcagacccucacaccagucggaaggcugaucaccgccaaccccgugauaacugaaucuacagagaacucaaaaaugauguuagagcuggauccgccuuucggcgacaguuauauuguaaucggggugggagauaagaaaaucacgcaccauuggcaccguagcgguuccaccauuggcaaggcuuuugaagccacuguucgaggggcaaaacggauggcgguccuaggagacacagcuugggauuucggcucugugggugggguguucaauucgcucggcaagggaauccaucagauuuuuggcgccgcauucaagagccuguuugggggaauguccugguucucacaaauacuuaucggcaccuugcuggucuggcucggucugaacacuaaaaaugggaguauuucucuuacaugccuggccuugggaggcguuaugaucuuucucagcaccgcuguguccgccgacguggguuguucaguagauuucagcaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8429 - RNA, 2359 nt, Artificial Sequence
  KF383120.1 prME-long mRNA Design 3 opt
gggagaaagcuuaccaugagaaucauuaacgccaggaaggagcggaaacgccgaggcgcugacaccagcauagggaucauuggacugcuccuuacaacugcaauggccgcggaaaucacgcguagagguuccgcuuacuauauguaccuggauaggucugacgccggcaaggcaauuucauucgccaccacaaugggggugaauaaaugccacguccagaucauggauuugggacauaugugugacgcuacuaugaguuaugagugccccauguuagaugaaggcguugagccugacgauguggacuguuggugcaacaccacaagcaccuggguaguguacgguacuugucaccauaagaaaggggaagcacggccaucccgcagagccgucacacugccgucucacucgaccaggaagcuacaaacgcggucacagacuuggcucgagagccgcgaguauaccaagcaucugauaaaaguggaaaauuggauccuucgaaaccccggauuuacaguugcugcccuggcgauggcaugguugcucggcaauaguacuucccagagagugauuuaccuggucaugauccugcucauugccccugcuuauucuaucaggugcauaggcgugagcaaccgggauuucguagaggggauguccggagguaccuggguugacguggucuuagaacacggcgggugugugacagugauggcccaggauaagccaaccgucgacauugagcugguuacgacuacagugucaaauauggcagagguacguaguuacugcuacgaagcuagcaucucugauauggccuccgacucacgcugucccacccaaggagaggcguaucuugacaaacagagcgauacucaguacgugugcaagagaacauuggucgacaggggcugggguaacggguguggacuguuuggcaaaggcagucuagugaccugcgccaaguucacgugcucuaagaaaaugaccgggaaguccauucagccugaaaaucucgaguaucggaucaugcugagcguucacggaucgcaacauucugguaugaucgugaacgauauuggccacgaaacagacgagaaucgagcaaaagucgaggugacuccaaacucaccccgcgcugaagccacccuugggggauuuggcucccuggguuuggauugugagccuagaacagggcucgacuucagugaucuguacuauuuaacuaugaauaacaagcauuggcugguacacaaagaaugguuucacgacauaccacucccguggcaugcuggcgccgauaccggaacaccccacuggaauaacaaggaggcacuuguugaguucaaagacgcccaugcuaagaggcagaccguggucgugcugggcagccaggaaggggcgguccacacugcauuggccggagcucuagaggccgaaauggauggugcaaagggccggcuguuuuccgggcaucucaaaugccgcaucaagauggacaaacugagacuuaagggagugucuuacagccuguguacggccgcuuucacauuuucaaaaguuccugccgagaccuugcacggcacugugaccguagaaguccaguaugcagguagggacgggccaugcaaggugcccgcgcaaauggcuguugauaugcagacacucaccccugugggccgucugauuacugccaacccaaucauaacagagaguacggaaaauucccggaugauguuagagcuggaucccccguucggagacagcuacauugucaucggcgugggggacaagaaaaucacccaccauuggcaccgaucuggaucaacuauugguaaggcauuugaggccacaguaagaggcgcuaaaaggauggccgugcuaggggauaccgcaugggacuucggaaguguuggcggugucuucaacagccucgggaagggcgugcaucagguguuuggagcugccuucaaaucccuguuuggcgggaugucuugguucucgcaaauccuuauuggaacauugcuggucuggcucggccugaauacuaagaacgguagcauaucccuugcgugucuggcccucgggggagcuaugaucuuuuugucaaccgcaguuagugccgaugugggcugcucuguggacuucugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8430 - RNA, 2290 nt, Artificial Sequence; identical to SEQ ID NO: 8265
  KU321639.1 prME-short mRNA Design 3 opt

SEQ ID NO: 8431 - RNA, 2290 nt, Artificial Sequence; identical to SEQ ID NO: 8266
  KU312312.1 prME-short mRNA Design 3 opt

SEQ ID NO: 8432 - RNA, 2278 nt, Artificial Sequence; identical to SEQ ID NO: 8267
  AY632535.2 prME-short mRNA Design 3 opt

SEQ ID NO: 8433 - RNA, 2290 nt, Artificial Sequence; identical to SEQ ID NO: 8268
  KU527068.1 prME-short mRNA Design 3 opt

SEQ ID NO: 8434 - RNA, 2290 nt, Artificial Sequence
  KX421193.1 prME-short mRNA Design 3 opt
gggagaaagcuuaccaugaccagcaucggcauuauagggcugcuccuuacaacugccauggcugcagagaucacgagaaggggauccgccuacuauauguaccuggaccggucugaugcggguaaggcuauuucauucgccaccacauugggcgugaacaaaugccacguccagaucauggacuuagggcauaugugugaugcaacuaugaguuaugaaugccccaugcuggacgagggaguugaaccugaugacguggauuguuggugcaauaccacaagcaccuggguaguguacggcacuugucaccauaagaaaggugaggcccgccgaucccguagagcugucacacuaccaucucacucgaccaggaagcuccaaacgcggucacagacuuggcuggaaagccgcgaguauaccaaacaucuuauuaagguggagaacuggaucuuuagaaauccgggguucgcacugguugccguggcuauagccugguugcucggaaguuccacaucucagaaggucaucuaccuggugaugauucugcucaucgcgcccgcauauagcauuaggugcaucggcguauccaaccgggacuuuguugaaggcaugucagggggaacuuggguggaugucguguuagagcacgguggcugugugaccgucauggcccaggacaaaccuacaguugauauagaacuggugaccacgacuguaaguaauauggcugaggugcgcagcuacugcuacgaggccucuauuuccgacauggcaucagauagccgauguccaacacaaggggaggcuuaucuugacaagcagagugacacccaguacgucugcaaaagaacuuugguggauaggggauggggcaacgguugugggcuguucggaaagggcucucuaguuacaugcgccaaauuuaccugcuccaagaagaugacgggcaaaagcauccagcccgaaaaucucgaauaucggauuaugcugucggugcacgggucucaacauuccggaaugaucgucaacgacaccgguuacgagacagaugaaaaucgugcgaagguggagguaacuccuaacucaccacgcgccgaggcaacccuuggcggguucggaagucugggcuuggacugugaacccagaacaggucucgauuuuagcgaccuguauuacuuaacuaugaauaacaaacacuggcugguucauaaggagugguuccacgauaucccucucccauggcacgcuggggccgacaccggcacaccgcauuggaauaacaaagaagcucuuguggaguuuaaggaugcccacgcaaaaaggcagaccgucgugguccugggaucccaggaaggcgccgugcauacugcuuuggcgggggcacuagaggccgagauggacggagcuaaggguaagcuguucucuggccaccucaaaugccggcugaagauggauaaacuucgacugaaggggguuagcuauucauuguguacggccgcauuuacauucaccaaagugcccgccgaaacucuccauggaaccguaacagucgaggugcaguacgcuggcaccgacgguccuugcaagauuccaguucaaauggccguggacaugcagacucugacacccgucgggcgcuuaauaacggcaaauccugugaucaccgaaaguacugagaacuccaagaugaugcuggaacuagauccacccuuuggcgacagcuacauuguaaucggagugggcgauaaaaagauaacacaccacuggcauagaucugggucaaccauuggaaaagcguucgaggcuacaguuaggggugccaagcggauggcaguccucggcgacacugccugggauuucgggagugugggaggcguguuuaacagccuggguaaagggauccaccagaucuucggcgcugccuuuaagucccuuuucggaggcaugucuugguuuucgcaaauuuugaucgggacccugcucgucuggcugggacuuaauacgaagaacggcagcauuucccugaccuguuuggcacucggugggguuaugauauuccugucaacagcugugagugccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8435 - RNA, 2290 nt, Artificial Sequence
  KX377335.1 prME-short mRNA Design 3 opt
gggagaaagcuuaccaugaccagcaucggcauuauagggcugcuccuuacaacugccauggcugcagagaucacgagaaggggauccgccuacuauauguaccuggaccggucugaugcggguaaggcuauuucauucgccaccacauugggcgugaacaaaugccacguccagaucauggacuuagggcauaugugugaugcaacuaugaguuaugaaugccccaugcuggacgagggaguugaaccugaugacguggauuguuggugcaauaccacaagcaccuggguaguguacggcacuugucaccgcaagaaaggugaggcccgacguuccagaagggcugucacacuaccaucucauucgacccggaagcuccaaacgcgcucacagacuuggcuggaaagcagagaguauaccaaacaccuuauuaagguggagaacuggaucuuuaggaauccgggguucgcacugguugccguggcuauagccugguugcucggaaguuccacaucucagaaggucaucuaccuggugaugauucugcucaucgcgcccgcauauagcauucggugcaucggcguauccaaccgcgacuuuguugaaggcaugucagggggaacuuggguggaugucguguuagagcaugguggcugugugaccgucauggcccaggacaaaccuacaguugauauagaacuggugaccacgacuguaaguaauauggcugaggugcgaagcuacugcuacgaggccucuauuuccgacauggcaucagauagcagauguccaacacaaggggaggcuuaucuugacaagcagagugacacccaguacgucugcaaaaggacuuugguggaucggggauggggcaacgguugugggcuguucggaaagggcucucuaguuacaugcgccaaauuuaccugcuccaagaagaugacgggcaaaagcauccagcccgaaaaucucgaauaucguauuaugcugucggugcacgggucucaacacuccggaaugaucgucaacgacaccgguuacgagacagaugaaaaucgcgcgaagguggagguaacuccuaacucaccaagagccgaggcaacccuuggcggguucggaagucugggcuuggacugugaacccaggacaggucucgauuuuagcgaccuguauuacuuaacuaugaauaacaaacauuggcugguucacaaggagugguuccaugauaucccucucccauggcacgcuggggccgacaccggcacaccgcacuggaauaacaaagaagcucuuguggaguuuaaggaugcccaugcaaaacggcagaccgucgugguccugggaucccaggaaggcgccgugcacacugcuuuggcgggggcacuagaggccgagauggacggagcuaaggguaagcuguucucuggccaucucaaaugccgacugaagauggauaaacuucgccugaaggggguuagcuauucauuguguacggccgcauuuacauucaccaaagugcccgccgaaacucuccacggaaccguaacagucgaggugcaguacgcuggcaccgacgguccuugcaagauuccaguucaaauggccguggacaugcagacucugacacccgucgggagauuaauaacggcaaauccugugaucaccgaaaguacugagaacuccaagaugaugcuggaacuagauccacccuuuggcgacagcuacauuguaaucggagugggcgauaaaaagauaacacaucacuggcacaggucugggucaaccauuggaaaagcguucgaggcuacaguucggggugccaagcgcauggcaguccucggcgacacugccugggauuucgggagugugggaggcguguuuaacagccuggguaaagggauccaucagaucuucggcgcugccuuuaagucccuuuucggaggcaugucuugguuuucgcaaauuuugaucgggacccugcucgucuggcugggacuuaauacgaagaacggcagcauuucccugaccuguuuggcacucggugggguuaugauauuccugucaacagcugugagugccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8436 - RNA, 2290 nt, Artificial Sequence
  LC002520.1 prME-short mRNA Design 3 opt
gggagaaagcuuaccaugaccagcaucggcauuauagggcugcuccuuacaacugccauggcugcagagaucacgagaaggggauccgccuacuauauguaccuggaccggucugaugcggguaaggcuauuucauucgccaccacauugggcgugaacaaaugccacguccagaucauggacuuagggcauaugugugaugcaacuaugaguuaugaaugccccaugcuggacgagggaguugaaccugaugacguggauuguuggugcaauaccacaagcaccuggguaguguacggcacuugucaccauaagaaaggugaggcccgccgaucccguagagcugucacacuaccaucucacucgaccaggaagcuccaaacgcggucacagacuuggcuggaaagccgcgaguauaccaaacaucuuauuaagguggagaacuggaucuuuagaaauccgggguucgcacugguugccguggcuauagccugguugcucggaaguuccacaucucagaaggucaucuaccuggugaugauucugcucaucgcgcccgcauauagcauuaggugcaucggcguauccaaccgggacuuuguugaaggcaugucagggggaacuuggguggaugucguguuagagcacgguggcugugugaccgucauggcccaggacaaaccuacaguugauauagaacuggugaccacgacuguaaguaauauggcugaggugcgcagcuacugcuacgaggccucuauuuccgacauggcaucagauagccgauguccaacacaaggggaggcuuaucuugacaagcagagugacacccaguacgucugcaaaagaacuuugguggauaggggauggggcaacgguugugggcuguucggaaagggcucucuaguuacaugcgccaaauuuaccugcuccaagaagaugacgggcaaaagcauccagcccgaaaaucucgaauaucggauuaugcugucggugcacgggucucaacauuccggaaugaccgucaacgacaucgguuacgagacagaugaaaaucgugcgaagguggagguaacuccuaacucaccacgcgccgaggcaacccuuggcggguucggaagucugggcuuggacugugaacccagaacaggucucgauuuuagcgaccuguauuacuuaacuaugaauaacaaacacuggcugguucauaaggagugguuccacgauaucccucucccauggcacgcuggggccgacaccggcacaccgcauuggaauaacaaagaagcucuuguggaguuuaaggaugcccacgcaaaaaggcagaccgucgugguccugggaucccaggaaggcgccgugcauacugcuuuggcgggggcacuagaggccgagauggacggagcuaaggguaagcuguucucuggccaccucaaaugccggcugaagauggauaaacuucgacugaaggggguuagcuauucauuguguacggccgcauuuacauucaccaaagugcccgccgaaacucuccauggaaccguaacagucgaggugcaguacgcuggcaccgacgguccuugcaagauuccaguucaaauggccguggacaugcagacucugacacccgucgggcgcuuaauaacggcaaauccugugaucaccgaaaguacugagaacuccaagaugaugcuggaacuagauccacccuuuggcgacagcuacauuguaaucggagugggcgauaaaaagauaacacaccacuggcauagaucugggucaaccauuggaaaagcguucgaggcuacaguuaggggugccaagcggauggcaguccucggcgacacugccugggauuucgggagugugggaggcguguuuaacagccuggguaaagggauccaccagaucuucggcgcugccuuuaagucccuuuucggaggcaugucuugguuuucgcaaauuuugaucgggacccugcucgucuggcugggacuuaauacgaagaacggcagcauuucccugaccuguuuggcacucggugggguuaugauauuccugucaacagcugugagugccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8437 - RNA, 2272 nt, Artificial Sequence
  DQ859059.1 prME-short mRNA Design 3 opt
gggagaaagcuuaccaugaccagcaucggcauuguggggcugcuccuuacaacugccauggcugcagagauaacgagaaggggauccgccuacuauauguaccuggaccggucugaugcggguaaggcuaucucauucgccaccacauugggcgucaacaaaugccacguucagauuauggacuuagggcauaugugugaugcaacuaugaguuaugaaugccccaugcuggacgagggaguggaaccugaugacguagauuguuggugcaauaccacaagcaccuggguggucuacggcacuugucaccauaagaaaggugaggcccgccgaucccguagagcugugacacuaccaucucacucgaccaggaagcuccaaacgcggucacagacuuggcuggaaagccgcgaguauaccaaacaucuuaucaagguugagaacuggauuuuuagaaauccgggguucacacugguggcagucgccaucgcuugguugcucggaaguuccacuucucagaaggugauauaccugguaaugauccugcucauugcccccgcguauagcaucaggugcauuggcguuuccaaccgggacuuuguggaaggcaugucagggggaaccugggucgaugugguguuagagcacgguggcugugucacaguuauggcacaggacaaaccuaccguggauaucgaacugguaacgacuacagugaguaauauggccgagguccgcagcuacugcuacgaggcuucuauauccgacauggccucagauagccgauguccaacccaaggggaagcauaucuugacaagcagagugacacucaguacgugugcaaaagaacauugguugauaggggauggggcaacgguugugggcuguucggaaagggcucucuagugaccugcgcuaaauuuacgugcuccaagaagaugaccggcaaaagcauucagcccgagaaucucgaauaucggaucaugcugucgguccacgggucucaacauuccggaaugauugugaacgacgagaaucgugccaagguagaaguuacaccuaacucaccacgcgcggaggccacucuugguggcuucgggagucugggauuggauugugagcccagaaccggccucgacuuuagcgaucuguacuauuuaacaaugaauaacaaacacuggcuggugcauaaggaaugguuccacgacaucccucucccauggcacgcaggggcugauacugggaccccgcauuggaauaacaaagaggcccuugucgaauuuaaggacgcucacgccaaaaggcagacaguggucgugcugggcucccaggagggagcaguucauaccgccuuggcuggcgcgcuagaagcagagauggauggggccaagggacggcuguucucuggucaccucaagugccgacugaaaauggacaaacuucgccugaagggcgugagcuacucauuguguacugcugccuuuacguucacaaagguacccgcagagacccuccaugggacugucaccguggaaguucaguaugccggaacagauggcccuugcaaagugccagcucaaauggccgucgacaugcagacccugacucccguggguagauuaaucacagcaaauccuguaauuacggagaguaccgaaaacuccaagaugaugcuggagcuagacccacccuuuggggauagcuacauagugaucggcguuggagacaagaaaauuacucaccacuggcauaggucuggcucaacaaucgggaaggcguucgaagcuaccguccggggagccaaacgcauggcagugcucggugauacagccugggacuucggcaguguggguggagucuuuaacagccugggcaaggguauacaccagauuuucggggcugccuuuaaaucccuuuucggcggaaugucuugguuuucgcaaaucuugaucggcacucugcucguuuggcuggggcuuaauaccaagaacggaagcauuucccugacguguuuggcacucggcggugugaugaucuuccugucaaccgcugugagugccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8438 - RNA, 2278 nt, Artificial Sequence
  KU963573.2 prME-short mRNA Design 3 opt
gggagaaagcuuaccaugaccagcaucggcauuauagggcugcuccuuacaacugccauggcugcagagaucacgagaaggggauccgccuacuauauguaccuggaccggucugaugcggguaaggcuauuucauucgccaccacauugggcgugaacaaaugccacguccagaucauggacuuagggcauaugugugaugcaacuaugaguuaugaaugccccaugcuggacgagggaguugaaccugaugacguggauuguuggugcaauaccacaagcaccuggguaguguacggcacuugucaccauaagaaaggugaggcccgccgaucccguagagcugucacacuaccaucucacucgaccaggaagcuccaaacgcggucacagacuuggcuggaaagccgcgaguauaccaaacaucuuauuaagguggagaacuggaucuuuagaaauccgggguucgcacugguugccguggcuauagccugguugcucggaaguuccacaucucagaaggucaucuaccuggugaugauucugcucaucgcgcccgcauauagcauuaggugcaucggcguauccaaccgggacuuuguugaaggcaugucagggggaacuuggguggaugucguguuagagcacgguggcugugugaccgucauggcccaggacaaaccuacaguugauauagaacuggugaccacgacuguaaguaauauggcugaggugcgcagcuacugcuacgaggccucuauuuccgacauggcaucagauagccgauguccaacacaaggggaggcuuaucuugacaagcagagugacacccaguacgucugcaaaagaacuuugguggauaggggauggggcaacgguugugggcuguucggaaagggcucucuaguuacaugcgccaaauuuaccugcuccaagaagaugacgggcaaaagcauccagcccgagaaucucgaauaucggauuaugcugucggugcacgggucucaacauuccggaaugaucgguuacgagaccgacgaaaaccgugcgaaggucgaggugacaccuaauucaccacgcgccgaggcaacucuuggcggguucggaagucugggcuuggauugugaacccagaaccggucucgacuuuagcgaucuguauuacuuaacaaugaacaauaaacacuggcugguacauaaggagugguuccacgacaucccucucccauggcacgcuggggccgauacuggcaccccgcauuggaacaauaaagaagcucuuguugaguuuaaggacgcccacgcaaaaaggcagacaguggucgugcugggaucccaggaaggcgccguccauaccgcuuuggcgggggcacuagaggccgagauggauggagcuaaggguaagcuguucucuggccaccucaaaugccggcugaagauggacaaacuucgacugaagggggugagcuauucauuguguacugccgcauuuacguucacaaaaguucccgccgaaacccuccauggaacugugaccguagagguccaguacgcuggcacagaugguccuugcaagauuccagugcaaauggccguugacaugcagacccugacucccguggggcgcuuaauaacagcaaacccugucaucacggaaaguaccgaaaauuccaagaugaugcuggaacuagacccacccuuuggcgauagcuacauugugaucggaguaggcgacaaaaagauaacucaccacuggcauagaucugggucaacaauuggaaaagcguucgaggcuaccgugaggggugccaagcggauggcaguucucggcgauacagccugggacuucgggagugucggaggcguguuuaacagccuggguaaagggauccaccagaucuucggcgcugccuuuaagucccuuuucggaggcaugucuugguuuucgcaaauuuugaucgggacucugcucguguggcugggacuuaacaccaagaauggcagcauuucccugacguguuuggcacucgguggggucaugauauuccugucaaccgcuguuagugccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8439 - RNA, 2290 nt, Artificial Sequence
  KX694534.2 prME-short mRNA Design 3 opt
gggagaaagcuuaccaugaccagcgugggcaucgucgggcugcuccuuacaacugccauggcugcagagguuacgagaaggggauccgccuacuauauguaccuggaccggaacgaugcgggugaagcuauuucuuuccccaccacauugggcaugaauaagugcuauauacagaucauggacuuagggcacaugugugaugccacuaugucauacgagugcccuaugcuggacgaaggaguggagccagaugacguagauuguuggugcaacaccacaaguaccuggguggucuauggcacuugucaucacaaaaagggugaagcacgccgaagccguagagccgugacacuaccgucccauucuaccaggaaacuccaaacgcggucgcagacuuggcuggagucacgcgaguacaccaagcaccuuauuagaguugaaaauuggaucuuuaggaaccccggguucgcucuggcagccgcugccauugcgugguugcucggaagcaguacaucccagaaagugaucuaucuggucaugauacugcucaucgcacccgccuacucuauucggugcaucggcgugagcaaucgcgacuuuguagagggcauguccgggggaacuuggguugauguggucuuagaacaugguggcugugugaccgugauggcucaggacaagccaacagucgauauugagcugguuaccacgacugugucaaacauggccgagguacgaaguuacugcuaugaagcaagcaucucugacauggcuuccgauucaagaugucccacacaaggggaggccuaccuugacaagcagagcgacacccaguaugugugcaaaaggacuuuggucgaucggggauggggcaaugguugugggcuguucggaaagggcagucuagugacaugcgcgaaauuugccugcucuaagaaaaugaccggcaaguccauacagccugaaaaccucgaguaccguauuaugcugagcguucacgggucgcaacacucuggaaugaucgugaaugacacgggucaugaaaccgaugagaaccgcgcaaaggucgagauuacaccaaauucccccagagcugaagccacucuuggcggguucggaucacugggcuuggacugugagccuaggaccggucucgauuuuagugaccuguauuacuuaacaaugaacaauaaacacuggcuggugcauaaggaaugguuccacgauaucccacucccguggcacgcuggggccgacacuggcaccccucauuggaacaauaaagaggcacuuguagaauuuaaggaugcccacgcuaaacggcagacaguugugguccugggaagccaggagggcgcggugcauaccgcauuggccggggcucuagaggccgaaauggacggagcaaagggucgacuguccucuggccaccucaaaugccgccugaagauggauaaacuuagacugaagggggucagcuauucauuguguacugccgcuuucacguuuacaaagaucccugccgagacccuccauggaacugugaccguugaagugcaguacgcaggcacagacgguccaugcaaaguacccgcgcaaauggcugucgacaugcagacccugacuccuguggggagguuaauuacagccaacccaguuauaacggagaguaccgaaaacuccaagaugaugcuggagcuagaucccccguucggcgacagcuacaucgugauuggagucggcgagaaaaagaucacucaccacuggcaucggucugggucaacaauaggaaaggcauuugaagccaccgugcgcggugcuaaaagaauggccguacucggcgauacagcaugggacuucgggagugugggaggcgcucugaauagccuugguagggggauucaccagaucuucggcgccgcguuuaaguccuuguucggaggcaugucuugguuuucgcaaauccugauugggacucuccugauguggcuuggacugaacaccaaaaauggcagcaucuccuugaugugucucgcccugggugggguuuuaauuuuccugucaacggcugucagugcaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8440 - RNA, 2290 nt, Artificial Sequence
  KX369547.1 prME-short mRNA Design 3 opt
gggagaaagcuuaccaugaccagcgugggcaucgucgggcugcuccuuacaacugccauggcugcagagguuacgagaaggggauccgccuacuauauguaccuggaccggaacgaugcgggugaagcuauuucuuuccccaccacauugggcaugaauaagugcuauauacagaucauggacuuagggcacaugugugaugccacuaugucauacgagugcccuaugcuggacgaaggaguggagccagaugacguagauuguuggugcaacaccacaaguaccuggguggucuauggcacuugucaucacaaaaagggugaagcacgccgaagccguagagccgugacacuaccgucccauucuaccaggaaacuccaaacgcggucgcagacuuggcuggagucacgcgaguacaccaagcaccuuauuagaguugaaaauuggaucuuuaggaaccccgggcuggcuuuggcagccgcugccauugcguggcuccugggaagcaguacaucccagaaagugaucuaucuggucaugauacucuuaaucgcacccgccuacucuauucggugcaucggcgugagcaaucgcgacuucguagagggcauguccgggggaacuuggguugaugugguccuggaacaugguggcugugugaccgugauggcucaggacaagccaacagucgauauugagcuuguuaccacgacugugucaaacauggccgagguacgaaguuacugcuaugaagcaagcaucucugacauggcuuccgauucaagaugucccacacaaggggaggccuacuuggacaagcagagcgacacccaguaugugugcaaaaggacucuggucgaucggggauggggcaaugguugugggcuauuuggaaagggcagucucgugacaugcgcgaaauucgccugcucuaagaaaaugaccggcaaguccauacagccugaaaaccuggaguaccguauuaugcuuagcguucacgggucgcaacacucuggaaugaucgugaaugacacgggucaugaaaccgaugagaaccgcgcaaaggucgagauuacaccaaauucccccagagcugaagccacucugggcggguuuggaucauugggccucgacugugagccuaggaccggucuggauuucagugacuuauauuaccugacaaugaacaauaaacacuggcucgugcauaaggaaugguuucacgauaucccacuuccguggcacgcuggggccgacacuggcaccccucauuggaacaauaaagaggcacugguagaguucaaggaugcccacgcuaaacggcagacaguuguggucuugggaagccaggaaggcgcggugcauaccgcacuagccggggcucuggaggccgaaauggacggagcaaagggucgacucuccucuggccaccugaaaugccgccuuaagauggauaagcugagauugaaaggggucagcuauucacucuguacugccgcuuuuacguucacaaagaucccugccgagacccugcauggaacugugaccguugaagugcaguacgcaggcacagacgguccaugcaaaguacccgcgcaaauggcugucgacaugcagaccuuaacuccuguggggaggcugauuacagccaacccaguuauaacggagaguaccgaaaacuccaagaugaugcuagagcucgaucccccguuuggcgacagcuacaucgugauuggagucggcgagaaaaagaucacucaccacuggcaucggucugggucaacaauaggaaaggcauucgaagccaccgugcgcggugcuaaaagaauggccguacugggcgauacagcaugggacuuugggagugugggaggcgcucuuaauagcuuggguaaggggauucaccagaucuucggcgccgcguucaaaucccuguuuggaggcaugucuugguucucgcaaauccucauugggacucugcuuauguggcugggauugaacaccaagaauggcagcaucucccucaugugucuggccuuaggugggguucugauuuuucuaucaacggcugucagugcaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8441 - RNA, 2290 nt, Artificial Sequence
  KX447515.1 prME-short mRNA Design 3 opt
gggagaaagcuuaccaugaccagcgugggcaucgucgggcugcuccuuacaacugccauggcugcagagguuacgagaaggggauccgccuacuauauguaccuggaccggaacgaugcgggugaagcuauuucuuuccccaccacauugggcaugaauaagugcuauauacagaucauggacuuagggcacaugugugaugccacuaugucauacgagugcccuaugcuggacgaaggaguggagccagaugacguagauuguuggugcaacaccacaaguaccuggguggucuauggcacuugucaucacaaaaagggugaagcacgccgaagccguagagccgugacacuaccgucccauucuaccaggaaacuccaaacgcggucgcagacuuggcuggagucacgcgaguacaccaagcaccuuauuagaguugaaaauuggaucuuuaggaaccccggguucgcucuggcagccgcugccauugcgugguugcucggaagcaguacaucccagaaagugaucuaucuggucaugauacugcucaucgcacccgccuacucuauucggugcaucggcgugagcaaucgcgacuuuguagagggcauguccgggggaacuuggguugauguggucuuagaacaugguggcugugugaccgugauggcucaggacaagccaacagucgauauugagcugguuaccacgacugugucaaacauggccgagguacgaaguuacugcuaugaagcaagcaucucugacauggcuuccgauucaagaugucccacacaaggggaggccuaccuugacaagcagagcgacacccaguaugugugcaaaaggacuuuggucgaucggggauggggcaaugguugugggcuguucggaaagggcagucuagugacaugcgcgaaauuugccugcucuaagaaaaugaccggcaaguccauacagccugaaaaccucgaguaccguauuaugcugagcguucacgggucgcaacacucuggaaugaucgugaaugacacgggucaugaaaccgaugagaaccgcgcaaaggucgagauuacaccaaauucccccagagcugaagccacucuuggcggguucggaucacugggcuuggacugugagccuaggaccggucucgauuuuagugaccuguauuacuuaacaaugaacaauaaacacuggcuggugcauaaggaaugguuccacgauaucccacucccguggcacgcuggggccgacacuggcaccccucauuggaacaauaaagaggcacuuguagaauuuaaggaugcccacgcuaaacggcagacaguugugguccugggaagccaggagggcgcggugcauaccgcauuggccggggcucuagaggccgaaauggacggagcaaagggucgacuguccucuggccaccucaaaugccgccugaagauggauaaacuuagacugaagggggucagcuauucauuguguacugccgcuuucacguuuacaaagaucccugccgagacccuccauggaacugugaccguugaagugcaguacgcaggcacagacgguccaugcaaaguacccgcgcaaauggcugucgacaugcagacccugacuccuguggggagguuaauuacagccaacccaguuauaacggagaguaccgaaaacuccaagaugaugcuggagcuagaucccccguucggcgacagcuacaucgugauuggagucggcgagaaaaagaucacucaccacugguaucggucugggucaacaauaggaaaggcauuugaagccaccgugcgcggugcuaaaagaauggccguacucggcgauacagcaugggacuucgggagugugggaggcgcucugaauagccuugguaaggggauucaucagaucuucggcgccgcguuuaaauccuuguucggaggcaugucuugguuuucgcaaauccugauugggacucuccugauguggcuuggacugaacaccaagaauggcagcaucuccuugaugugucucgcccugggugggguuuuaauuuuccugucaacggcugucagugcaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8442 - RNA, 2290 nt, Artificial Sequence
  KU729218.1 prME-short mRNA Design 3 opt
gggagaaagcuuaccaugaccagcgugggcaucgucgggcugcuccuuacaacugccauggcugcagagguuacgagaaggggauccgccuacuauauguaccuggaccggaacgaugcgggugaagcuauuucuuuccccaccacauugggcaugaauaagugcuauauacagaucauggacuuagggcacaugugugaugccacuaugucauacgagugcccuaugcuggacgaaggaguggagccagaugacguagauuguuggugcaacaccacaaguaccuggguggucuauggcacuugucaucacaaaaagggugaagcacgccgaagccguagagccgugacacuaccgucccauucuaccaggaaacuccaaacgcggucgcagacuuggcuggagucacgcgaguacaccaagcaccuuauuagaguugaaaauuggaucuuuaggaaccccggguucgcucuggcagccgcugccauugcgugguugcucggaagcaguacaucccagaaagugaucuaucuggucaugauacugcucaucgcacccgccuacucuauucggugcaucggcgugagcaaucgcgacuuuguagagggcauguccgggggaacuuggguugauguggucuuagaacaugguggcugugugaccgugauggcucaggacaagccaacagucgauauugagcugguuaccacgacugugucaaacauggccgagguacgaaguuacugcuaugaagcaagcaucucugacauggcuuccgauucaagaugucccacacaaggggaggccuaccuugacaagcagagcgacacccaguaugugugcaaaaggacuuuggucgaucggggauggggcaaugguugugggcuguucggaaagggcagucuagugacaugcgcgaaauuugccugcucuaagaaaaugaccggcaaguccauacagccugaaaaccucgaguaccguauuaugcugagcguucacgggucgcaacacucuggaaugaucgugaaugacacgggucaugaaaccgaugagaaccgcgcaaaggucgagauuacaccaaauucccccagagcugaagccacucuuggcggguucggaucacugggcuuggacugugagccuaggaccggucucgauuuuagugaccuguauuacuuaacaaugaacaauaaacacuggcuggugcauaaggaaugguuccacgauaucccacucccguggcacgcuggggccgacacuggcaccccucauuggaacaauaaagaggcacuuguagaauuuaaggaugcccacgcuaaacggcagacaguugugguccugggaagccaggagggcgcggugcauaccgcauuggccggggcucuagaggccgaaauggacggagcaaagggucgacuguccucuggccaccucaaaugccgccugaagauggauaaacuuagacugaagggggucagcuauucauuguguacugccgcuuucacguuuacaaagaucccugccgagacccuccauggaacugugaccguugaagugcaguacgcaggcacagacgguccaugcaaaguacccgcgcaaauggcugucgacacccagacucugacaccuguggggagguuaauuacggccaacccaguuauaaccgagaguacugaaaacuccaagaugaugcuggagcuagaucccccguucggcgacagcuacaucgugauuggagucggcgagaaaaagaucacacaccacuggcaucggucugggucaaccauaggaaaggcauuugaagccacagugcgcggugcuaaaagaauggccguacucggcgauacugcaugggacuucgggagugugggaggcgcucugaauagccuugguaaggggauucaccagaucuucggcgccgcguuuaaauccuuguucggaggcaugucuugguuuucgcaaauccugauugggacccuccugauguggcuuggacugaacacgaagaauggcagcaucuccuugaugugucucgcccugggugggguuuuaauuuuccugucaaccgcugucagugcaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8443 - RNA, 2290 nt, Artificial Sequence
  KU501217.1 prME-short mRNA Design 3 opt
gggagaaagcuuaccaugaccagcgugggcaucgucgggcugcuccuuacaacugccauggcugcagagguuacgagaaggggauccgccuacuauauguaccuggaccggaacgaugcgggugaagcuauuucuuuccccaccacauugggcaugaauaagugcuauauacagaucauggacuuagggcacaugugugaugccacuaugucauacgagugcccuaugcuggacgaaggaguggagccagaugacguagauuguuggugcaacaccacaaguaccuggguggucuauggcacuugucaucacaaaaagggugaagcacgccgaagccguagagccgugacacuaccgucccauucuaccaggaaacuccaaacgcggucgcagacuuggcuggagucacgcgaguacaccaagcaccuuauuagaguugaaaauuggaucuuuaggaaccccggguucgcucuggcagccgcugccauugcgugguugcucggaagcaguacaucccagaaagugaucuaucuggucaugauacugcucaucgcacccgccuacucuauucggugcaucggcgugagcaaucgcgacuuuguagagggcauguccgggggaacuuggguugauguggucuuagaacaugguggcugugugaccgugauggcucaggacaagccaacagucgauauugagcugguuaccacgacugugucaaacauggccgagauccgaaguuacugcuaugaagcaagcauaucugacauggcuuccgauucaagaugucccacacaaggggaggccuaccuugacaagcagagcgacacccaguauguaugcaaaaggacuuugguggaucggggauggggcaaugguugugggcuguucggaaagggcagucuagucacaugcgcgaaauuugccugcucuaagaaaaugaccggcaaguccauucagccugaaaaccucgaguaccguaucaugcugagcgugcacgggucgcaacacucuggaaugauuguuaaugacacgggucaugaaaccgaugagaaccgcgcaaagguggagaucacaccaaauucccccagagcugaagccacucuuggcggguucggaucacugggcuuggacugugagccuaggaccggucucgauuuuagugaccuguauuacuuaacaaugaacaauaaacacuggcugguccauaaggaaugguuccacgauaucccacucccguggcacgcuggggccgacacuggcaccccucauuggaacaauaaagaggcacuuguggaauuuaaggaugcccacgcuaaacggcagacaguaguugugcugggaagccaggagggcgcgguccauaccgcauuggccggggcucuagaggccgaaauggacggagcaaagggucgacuguccucuggccaccucaaaugccgccugaagauggauaaacuuagacugaagggggugagcuauucauuguguacugccgcuuucacguuuacaaagauuccugccgagacccuccauggaacugucaccguggaaguucaguacgcaggcacagacgguccaugcaaagugcccgcgcaaauggcuguagacaugcagacccugacuccugucgggagguuaauaacagccaacccagugaucacggagaguaccgaaaacuccaagaugaugcuggagcuagaucccccguucggcgacagcuacauuguuaucggagugggcgagaaaaagauaacucaccacuggcaucggucugggucaacaauuggaaaggcauuugaagccaccguccgcggugcuaaaagaauggccgugcucggcgauacagcaugggacuucgggaguguaggaggcgcucugaauagccuugguaaggggauccaccagaucuucggcgccgcguuuaaauccuuguucggaggcaugucuugguuuucgcaaauucugaucgggacucuccugauguggcuuggacugaacaccaagaauggcagcauuuccuugaugugucucgcccugggugggguguuaauauuccugucaacggcuguuagugcaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8444 - RNA, 2290 nt, Artificial Sequence
  KU312314.1 prME-short mRNA Design 3 opt
gggagaaagcuuaccaugaccagcgugggcaucgucgggcugcuccuuacaacugccauggcugcagagguuacgagaaggggauccgccuacuauauguaccuggaccggaacgaugcgggugaagcuauuucuuuccccaccacauugggcaugaauaagugcuauauacagaucauggacuuagggcacaugugugaugccacuaugucauacgagugcccuaugcuggacgaaggaguggagccagaugacguagauuguuggugcaacaccacaaguaccuggguggucuauggcacuugucaucacaaaaagggugaagcacgccgaagccguagagccgugacacuaccgucccauucuaccaggaaacuccaaacgcggucgcagacuuggcuggagucacgcgaguacaccaagcaccuuauuagaguugaaaauuggaucuuuaggaaccccggguucgcucuggcagccgcugccauugcgugguugcucggaagcaguacaucccagaaagugaucuaucuggucaugauacugcucaucgcacccgccuacucuauucggugcaucggcgugagcaaucgcgacuuuguagagggcauguccgggggaacuuggguugauguggucuuagaacaugguggcugugugaccgugauggcucaggacaagccaacagucgauauugagcugguuaccacgacugugucaaacauggccgagguacgaaguuacugcuaugaagcaagcaucucugacauggcuuccgauucaagaugucccacacaaggggaggccuaccuugacaagcagagcgacacccaguaugugugcaaaaggacuuuggucgaucggggauggggcaaugguugugggcuguucggaaagggcagucuagugacaugcgcgaaauuugccugcucuaagaaaaugaccggcaaguccauacagccugaaaaccucgaguaccguauuaugcugagcguucacgggucgcaacacucuggaaugaucgugaaugacacgggucaugaaaccgaugagaaccgcgcaaaggucgagauuacaccaaauucccccagagcugaagccacucuuggcggguucggaucacugggcuuggacugugagccuaggaccggucucgauuuuagugaccuguauuacuuaacaaugaacaauaaacacuggcuggugcauaaggaaugguuccacgauaucccacucccguggcacgcuggggccgacacuggcaccccucauuggaacaauaaagaggcacuuguagaauuuaaggaugcccacgcuaaacggcagacaguugugguccugggaagccaggagggcgcggugcauaccgcauuggccggggcucuagaggccgaaauggacggagcaaagggucgacuguccucuggccaccucaaaugccgccugaagauggauaaacuuagacugaagggggucagcuauucauuguguacugccgcuuucacguuuacaaagaucccugccgagacccuccauggaacugugaccguugaagugcaguacgcaggcacagacgguccaugcaaaguacuggcgcaaauggcugucgacaugcagaccuuaacucccguggggaggcugauuacagccaacccuguuauaacggagaguaccgaaaacuccaagaugaugcuagagcucgauccacccuucggcgacagcuacaucgugauuggagucggcgagaaaaagaucacucaccacuggcaucggucugggucaacaauaggaaaggcauuugaagccaccgugcgcggugcuaaaagaauggccguacugggcgauacagcaugggacuucgggagugugggaggcgcucuuaauagcuuggguaaggggauucaccagaucuucggcgccgcguuuaaaucccuguucggaggcaugucuugguuuucgcaaauccucauugggacucugcuuauguggcugggauugaacaccaagaauggcagcaucucccucaugugucuggccuuaggugggguucugauuuuccuaucaacggcugucagugcaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8445 - RNA, 2290 nt, Artificial Sequence
  KX446950.2 prME-short mRNA Design 3 opt
gggagaaagcuuaccaugaccagcgugggcaucgucgggcugcuccuuacaacugccauggcugcagagguuacgagaaggggauccgccuacuauauguaccuggaccggaacgaugcgggugaagcuauuucuuuccccaccacauugggcaugaauaagugcuauauacagaucauggacuuagggcacaugugugaugccacuaugucauacgagugcccuacccuggacgaaggaguggagccagaugacguagauuguuggugcaacacaaccaguacuuggguggucuauggcacaugucaucacaaaaagggugaagcacgccgaagccguagagccgugacccuaccgucccauucuacgaggaaacuccaaacucggucgcagaccuggcuggagucacgcgaguacacaaagcaccuuauuagaguugaaaauuggaucuuuaggaaccccggguucgcucuggcagccgcugccauugcgugguugcucggaagcaguacuucccagaaagugaucuaucuggucaugauacugcucaucgccccugcauacucuauucggugcaucggcgugagcaaucgcgacuuuguagagggcauguccgggggaaccuggguugauguggucuuagaacaugguggcugugugacagugauggcucaggacaagccaaccgucgauauugagcugguuacgacuacagugucaaacauggccgagguacgaaguuacugcuaugaagcaagcaucucugacauggcuuccgauucaagaugucccacccaaggggaggccuaccuugacaagcagagcgacacucaguaugugugcaaaaggacauuggucgaucggggauggggcaaugguugugggcuguucggaaagggcagucuagugaccugcgcgaaauuugccugcucuaagaaaaugacgggcaaguccauacagccugaaaaccucgaguaccguauuaugcugagcguucacgggucgcaacacucuggaaugaucgugaaugacaccggucaugaaacagaugagaaccgcgcaaaggucgagauuacuccaaauucccccagagcugaagccacccuuggcggguucggaucacugggcuuggacugugagccuaggacaggucucgauuuuagugaccuguauuacuuaacuaugaacaauaaacacuggcuggugcauaaggaaugguuccacgauaucccacucccguggcacgcuggggccgacaccggcacaccccauuggaacaauaaagaggcacuuguagaauuuaaggaugcccacgcuaaacggcagaccguugugguccugggaagccaggagggcgcggugcauacugcauuggccggggcucuagaggccgaaauggacggagcaaagggucgacuguccucuggccaccucaaaugccgccugaagauggauaaacuuagacugaagggggucagcuauucauuguguacggccgcuuucacauuuaccaagaucccugccgagacucuccauggaaccgugacaguugaagugcaguacgcaggcaccgacgguccaugcaaaguacccgcgcaaauggcugucgacaugcagacucugacaccuguggggagguuaauuacggccaacccaguuauaaccgagaguacugaaaacuccaagaugaugcuggagcuagaucccccguucggcgacagcuacaucgugauuggagucggcgagaaaaagaucacacaccacuggcaucggucugggucaaccauaggaaaggcauuugaagccacagugcgcggugcuaaaagaauggccguacucggcgauacugcaugggacuucgggagugugggaggcgcucugaauagccuugguaaggggauucaccagaucuucggcgccgcguuuaaauccuuguucggaggcaugucuugguuuucgcaaauccugauugggacccuccugauguggcuuggacugaacacgaagaauggcagcaucuccuugaugugucucgcccugggugggguuuuaauuuuccugucaaccgcugucagugcaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8446 - RNA, 2290 nt, Artificial Sequence
  KY003157.1 prME-short mRNA Design 3 opt
gggagaaagcuuaccaugaccagcgugggcaucgucgggcugcuccuuacaacugccauggcugcagagguuacgagaaggggauccgccuacuauauguaccuggaccggaacgaugcgggugaagcuauuucuuuccccaccacauugggcaugaauaagugcuauauacagaucauggacuuagggcacaugugugaugccacuaugucauacgagugcccuaugcuggacgaaggaguggagccagaugacguagauuguuggugcaacaccacaaguaccuggguggucuauggcacuugucaucacaaaaagggugaagcacgccgaagccguagagccgugacacuaccgucccauucuaccaggaaacuccaaacgcggucgcagacuuggcuggagucacgcgaguacaccaagcaccuuauuagaguugaaaauuggaucuuuaggaaccccggguucgcucuggcagccgcugccauugcgugguugcucggaagcaguacaucccagaaagugaucuaucuggucaugauacugcucaucgcacccgccuacucuauucggugcaucggcgugagcaaucgcgacuuuguagagggcauguccgggggaacuuggguugauguggucuuagaacaugguggcugugugaccgugauggcucaggacaagccaacagucgauauugagcugguuaccacgacugugucaaacauggccgagguacgaaguuacugcuaugaagcaagcaucucugacauggcuuccgauucaagaugucccacacaaggggaggccuaccuugacaagcagagcgacacccaguaugugugcaaaaggacuuuggucgaucggggauggggcaaugguugugggcuguucggaaagggcagucuagugacaugcgcgaaauuugccugcucuaagaaaaugaccggcaaguccauacagccugaaaaccucgaguaccguauuaugcugagcguucacgggucgcaacacucuggaaugaucgugaaugacacgggucaugaaaccgaugagaaccgcgcaaaggucgagauuacaccaaauucccccagagcugaagccacucuuggcggguucggaucacugggcuuggacugugagccuaggaccggucucgauuuuagugaccuguauuacuuaacaaugaacaauaaacacuggcuggugcauaaggaaugguuccacgauaucccacucccguggcacgcuggggccgacacuggcaccccucauuggaacaauaaagaggcacuuguagaauuuaaggaugcccacgcuaaacggcagacaguugugguccugggaagccaggagggcgcggugcauaccgcauuggccggggcucuagaggccgaaauggacggagcaaagggucgacuguccucuggccaccucaaaugccgccugaagauggauaaacuuagacugaagggggucagcuauucauuguguacugccgcuuucacguuuacaaagaucccugccgagacccuccauggaacugugaccguugaagugcaguacgcaggcacagacgguccaugcaaaguacccgcgcaaauggcugucgacaugcagacccugacuccuguggggagguuaauuacagccaacccaguuauaacggagaguaccgaaaacuccaagaugaugcuggagcuagaucccccguucggcgacagcuacaucgugauuggagucggcgagaaaaagaucacucaccacuggcaucggucugggucaacaauaggaaaggcauuugaagccaccgugcgcggugcuaaaagaauggccguacucggcgauacagcaugggacuucgggagugugggaggcgcucugaauagccuugguaaggggauucaccagaucuucggcgccgcguuuaaauccuuguucggaggcaugucuugguuuucgcaaauccugauugggacucuccugauguggcuuggacugaacaccaagaauggcagcaucuccuugaugugucucgcccugggugggguuuuaauuuuccugucaacggucgugagugcuugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8447 - RNA, 2290 nt, Artificial Sequence
  KX811222.1 prME-short mRNA Design 3 opt
gggagaaagcuuaccaugaccagcgugggcaucgucgggcugcuccuuacaacugccauggcugcagagguuacgagaaggggauccgccuacuauauguaccuggaccggaacgaugcgggugaagcuauuucuuuccccaccacauugggcaugaauaagugcuauauacagaucauggacuuagggcacaugugugaugccacuaugucauacgagugcccuaugcuggacgaaggaguggagccagaugacguagauuguuggugcaacaccacaagugcauggguggucuauggcaccugucaucacaaaaagggugaagcccgccgaagccguagagcugugacucuaccgucccauucuacaaggaaacuccaaacccggccccagacguggcuggagucgcgcgaguacacuaagcaccuuauuagaguugaaaauuggaucuuuaggaacccuggguucgcacuggccgcugccgcgauugcaugguugcucggaucaagcaccagucagaaagugaucuaucuggucaugauacugcucaucgccccagcuuacuccauucggugcaucggcgugucuaaucgcgacuuuguagagggcaugagcgggggaacauggguugauguggucuuagaacaugguggcugugugacugugauggcccaggacaagcccaccgucgauauugagcugguuacaaccacgguguccaacauggcagagguacgaucauacugcuaugaagcuaguaucagcgacauggccucugauuccagauguccuacucaaggggaggcguaccuugacaagcagucagacacacaguaugugugcaaaaggaccuuggucgaucggggauggggcaaugguugugggcuguucggaaagggcagccuagugacuugcgccaaauuugcaugcaguaagaaaaugacaggcaagucuauacagccagaaaaccucgaguaccguauuaugcuguccguucacgggagccaacacucgggaaugaucgugaaugacaccggucaugaaacggaugagaaccgcgcuaaggucgagauuacccccaauucuccuagagccgaagcuacacuuggcggguucggaucccugggcuuggacugugagccaaggacuggucucgauuuuucagaccuguauuacuuaaccaugaacaauaaacacuggcuggugcauaaggaaugguuccacgauaucccgcuccccuggcacgccggggcagacacaggcacuccucauuggaacaauaaagaggcccuuguagaauuuaaggaugcucacgcgaaacggcagaccguugugguccugggaagucaggagggcgcagugcauacagccuuggcuggggcccuagaggcagaaauggacggagccaagggucgacugagcuccggccaccucaaaugccgccugaagauggauaaacuuagacugaaaggggucucuuauagcuuguguaccgcugccuucacuuuuacgaagaucccagcagagacacuccauggaaccgugacuguugaagugcaguacgcgggcaccgacggucccugcaaaguaccugcucaaauggccgucgacaugcagacacugaccccaguggggagguuaauuacugcaaaccccguuauaacagagucaacggaaaacaguaagaugaugcuggagcuagauccgccuuucggcgacuccuacaucgugauuggagucggcgagaaaaagaucacccaccacuggcaucggagcgggucuacuauaggaaaggccuuugaagcuacagugcgcggugccaaaagaauggcaguacucggcgauaccgcuugggacuucgggucagugggaggcgcccugaauagucuugguaaggggauucaccagaucuucggcgcggccuuuaagagcuuguucggaggcauguccugguuuucucaaauccugauugggacacuccugauguggcuuggacugaacacuaagaauggcucgaucagcuugaugugucucgcucugggugggguuuuaauuuuccuguccaccgcagucucagccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8448 - RNA, 2290 nt, Artificial Sequence
  KX447516.1 prME-short mRNA Design 3 opt
gggagaaagcuuaccaugaccagcgugggcaucgucgggcugcuccuuacaacugccauggcugcagagguuacgagaaggggauccgccuacuauauguaccuggaccggaacgaugcgggugaagcuauuucuuuccccaccacauugggcaugaauaagugcuauauacagaucauggacuuagggcacaugugugaugccacuaugucauacgagugcccuaugcuggacgaaggaguggagccagaugacguagauuguuggugcaacaccacaaguaccuggguggucuauggcacuugucaucacaaaaagggugaagcacgccgaagccguagagccgugacacuaccgucccauucuaccaggaaacuccaaacgcggucgcagacuuggcuggagucacgcgaguacaccaagcaccuuauuagaguugaaaauuggaucuuuaggaaccccggguucgcucuggcagccgcugccauugcgugguugcucggaagcaguacauccaaaaaggugaucuaucuggucaugauacugcucaucgcacccgccuacucuauucggugcaucggcgugagcaaucgcgacuuuguagagggcauguccgggggaacuuggguugauguggucuuagaacaugguggcugugugaccgugauggcucaggacaagccaacagucgauauugagcugguuaccacgacugugucaaacauggccgagguacgaaguuacugcuaugaagcaagcaucucugacauggcuuccgauucaagaugucccacacagggggaggccuaccuugacaaacaaagcgacacccaguaugugugcaagaggacuuuggucgaucggggauggggcaaugguugugggcuguucggaaaaggcagucuagugacaugcgcgaaguuugccugcucuaaaaagaugaccggcaaguccauacagccugaaaaccucgaguaccguauuaugcugagcguucacgggucgcagcacucuggaaugaucgugaaugacacgggucaugaaaccgaugagaaccgcgcaaaagucgagauuacaccaaauucccccagagcugaagccacucuuggcggguucggaucacugggcuuggacugugagccuaggaccggucucgauuuuagugaccuguauuacuuaacaaugaacaauaagcacuggcuggugcauaaagaaugguuccacgauaucccacucccguggcacgcuggggccgacacuggcaccccucauuggaacaauaaggaggcacuuguagaauuuaaagaugcccacgcuaagcggcaaacaguugugguccugggaagccaggagggcgcggugcauaccgcauuggccggggcucuagaggccgaaauggacggagcaaaaggucgacuguccucuggccaccucaagugccgccugaagauggauaaacuuagacugaagggggucagcuauucauuguguacugccgcuuucacguuuacaaaaaucccugccgagacccuccauggaacugugaccguugaagugcaguacgcaggcacagacgguccaugcaagguacccgcgcagauggcugucgacaugcaaacccugacuccuguggggagguuaauuacagccaacccaguuauaacggagaguaccgaaaacuccaaaaugaugcuggagcuagaucccccguucggcgacagcuacaucgugauuggagucggcgagaagaagaucacucaccacuggcaucggucugggucaacaauaggaaaagcauuugaagccaccgugcgcggugcuaagagaauggccguacucggcgauacagcaugggacuucgggagugugggaggcgcucugaauagccuugguaaagggauucaccagaucuucggcgccgcguuuaaguccuuguucggaggcaugucuugguuuucgcagauccugauugggacucuccugauguggcuuggacugaacaccaaaaauggcagcaucuccuugaugugucucgcccugggugggguuuuaauuuuccugucaacggcugucagugcaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8449 - RNA, 2290 nt, Artificial Sequence
  KX520666.1 prME-short mRNA Design 3 opt
gggagaaagcuuaccaugaccagcgugggcaucgucgggcugcuccuuacaacugccauggcugcagagguuacgagaaggggauccgccuacuauauguaccuggaccggaacgaugcgggugaagcuauuucuuuccccaccacauugggcaugaauaagugcuauauacagaucauggacuuagggcacaugugugaugccacuaugucauacgagugcccuaugcuggacgaaggaguggagccagaugacguagauuguuggugcaacaccacaaguaccuggguggucuauggcacuugucaucacaaaaagggugaagcacgccgaagccguagagccgugacacuaccgucccauucuaccaggaaacuccaaacgcggucgcagacuuggcuggagucacgcgaguacaccaagcaccuuauuagaguugaaaauuggaucuuuaggaaccccggguucgcucuggcagccgcugccauugcgugguugcucggaagcaguacacggcagaaagugaucuaucuggucaugauacugcucaucgcacccgccuacuccauucgcugcaucggcgugucuaaucgagacuuuguagagggcaugagcgggggaacuuggguugauguggucuuagaacaugguggcugugugaccgugauggcucaggacaagccaacagucgauauugagcugguuaccacgacuguguccaacauggccgagguaagaucauacugcuaugaagcaaguaucagcgacauggcuucugauuccaggugucccacacaaggggaggccuaccuugacaagcagucagacacccaguaugugugcaaacggacuuuggucgaucguggauggggcaaugguugugggcuguucggaaagggcagccuagugacaugcgcgaaauuugccugcaguaagaaaaugaccggcaagucuauacagccugaaaaccucgaguaccgcauuaugcuguccguucacgggagccaacacucgggaaugaucgugaaugacacgggucaugaaaccgaugagaacagagcaaaggucgagauuacaccaaauucucccagggcugaagccacucuuggcggguucggaucccugggcuuggacugugagccucggaccggucucgauuuuucagaccuguauuacuuaacaaugaacaauaaacacuggcuggugcauaaggaaugguuccacgauaucccacucccguggcacgcuggggccgacacuggcaccccucauuggaacaauaaagaggcacuuguagaauuuaaggaugcccacgcuaaacgacagacaguugugguccugggaagucaggagggcgcggugcauaccgcauuggccggggcucuagaggccgaaauggacggagcaaagggucgccugagcuccggccaccucaaaugcagacugaagauggauaaacuuaggcugaaaggggucucuuauagcuuguguacugccgcuuucacguuuacaaagaucccugccgagacccuccauggaacugugaccguugaagugcaguacgcaggcacagacgguccaugcaaaguacccgcgcaaauggcugucgacaugcagacccugacuccuguggggcgguuaauuacagccaacccaguuauaacggagucaaccgaaaacaguaagaugaugcuggagcuagaucccccguucggcgacuccuacaucgugauuggagucggcgagaaaaagaucacucaccacuggcaucgcagcgggucuacaauaggaaaggcauuugaagccaccgugagaggugcuaaaaggauggccguacucggcgauacagcaugggacuucgggucagugggaggcgcucugaauagucuugguaaggggauucaccagaucuucggcgccgcguuuaagagcuuguucggaggcauguccugguuuucucaaauccugauugggacucuccugauguggcuuggacugaacaccaagaauggcucgaucagcuugaugugucucgcccugggugggguuuuaauuuuccuguccacggcugucucagcaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8450 - RNA, 2290 nt, Artificial Sequence
  KU497555.1 prME-short mRNA Design 3 opt
gggagaaagcuuaccaugaccagcgugggcaucgucgggcugcuccuuacaacugccauggcugcagagguuacgagaaggggauccgccuacuauauguaccuggaccggaacgaugcgggugaagcuauuucuuuccccaccacauugggcaugaauaagugcuauauacagaucauggacuuagggcacaugugugaugccacuaugucauacgagugcccuaugcuggacgaaggaguggagccagaugacguagauuguuggugcaacaccacaaguaccuggguggucuauggcacuugucaucacaaaaagggugaagcacgccgaagccguagagccgugacacuaccgucccauucuaccaggaaacuccaaacgcggucgcagacuuggcuggagucacgcgaguacaccaagcaccuuauuagaguugaaaauuggaucuuuaggaaccccggguucgcucuggcagccgcugccauugcgugguugcucggaagcaguacaucccagaaagugaucuaucuggucaugauacugcucaucgcacccgccuacucuauucggugcaucggcgugagcaaucgcgacuuuguagagggcauguccgggggaacuuggguugauguggucuuagaacaugguggcugugugaccgugauggcucaggacaagccaacagucgauauugagcugguuaccacgacugugucaaacauggccgagguacgaaguuacugcuaugaagcaagcaucucugacauggcuuccgauucaagaugucccacacaaggggaggccuaccuugacaagcagagcgacacccaguaugugugcaaaaggacuuuggucgaucggggauggggcaaugguugugggcuguucggaaagggcagucuagugacaugcgcgaaauuugccugcucuaagaaaaugaccggcaaguccauacagccugaaaaccucgaguaccguauuaugcugagcguucacgggucgcaacacucuggaaugaucgugaaugacacgggucaugaaaccgaugagaaccgcgcaaaggucgagauuacaccaaauucccccagagcugaagccacucuuggcggguucggaucacugggcuuggacugugagccuaggaccggucucgauuuuagugaccuguauuacuuaacaaugaacaauaaacacuggcuggugcauaaggaaugguuccacgauaucccacucccguggcacgcuggggccgacacuggcaccccucauuggaacaauaaagaggcacuuguagaauuuaaggaugcccacgcuaaacggcagacaguugugguccugggaacccaggagggcgcggugcauacugcauuggccggggcucuagaggccgaaauggacggagcaaagggucgacugagcuccggccaccucaaaugccgccugaagauggauaaacuuagacugaaaggggucucuuauagcuuguguacggccgcuuucacauuuaccaagaucccugccgagacucuccauggaaccgugacaguugaagugcaguacgcaggcaccgacgguccaugcaaaguacccgcgcaaauggcugucgacaugcagacucugacaccuguggggagguuaauuacggccaacccaguuauaaccgagucaacugaaaacaguaagaugaugcuggagcuagaucccccguucggcgacuccuacaucgugauuggagucggcgagaaaaagaucacacaccacuggcaucggagcgggucuaccauaggaaaggcauuugaagccacagugcgcggugcuaaaagaauggccguacucggcgauacugcaugggacuucgggucagugggaggcgcucugaauagucuugguaaggggauucaccagaucuucggcgccgcguuuaagagcuuguucggaggcauguccugguuuucucaaauccugauugggacccuccugauguggcuuggacugaacacgaagaauggcucgaucagcuugaugugucucgcccugggugggguuuuaauuuuccuguccaccgcugucucagcaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8451 - RNA, 2290 nt, Artificial Sequence
  KY075939.1 prME-short mRNA Design 3 opt
gggagaaagcuuaccaugaccagcgugggcaucgucgggcugcuccuuacaacugccauggcugcagagguuacgagaaggggauccgccuacuauauguaccuggaccggaacgaugcgggugaagcuauuucuuuccccaccacauugggcaugaauaagugcuauauacagaucauggacuuagggcacaugugugaugccacuaugucauacgagugcccuaugcuggacgaaggaguggagccagaugacguagauuguuggugcaacaccacaaguaccuggguggucuauggcacuugucaucacaaaaagggugaagcacgccgaagccguagagccgugacacuaccgucccauucuaccaggaaacuccaaacgcggucgcagacuuggcuggagucacgcgaguacaccaagcaccuuauuagaguugaaaauuggaucuuuaggaaccccggguucgcucuggcagccgcugccauugcgugguugcucggaagcaguacaucccagaaagugaucuaucuggucaugauacugcucaucgcacccgccuacucuuuacggugcauuggcgugagcaaucgcgacuuuguagagggcauguccgggggaacuuggguugaugugguccuggaacaugguggcugugugaccgugauggcucaggacaagccaacagucgauaucgagcuuguuaccacgacugugucaaacauggccgagguacgaaguuacugcuaugaagcaagcauuucugacauggcuuccgauucaagaugucccacacaaggggaggccuacuuggacaagcagagcgacacccaguaugugugcaaaaggacucuggucgaucggggauggggcaaugguugugggcuauucggaaagggcagucucgugacaugcgcgaaauuugccugcucuaagaaaaugaccggcaaguccauccagccugaaaaccuggaguaccguauaaugcuuagcguucacgggucgcaacacucuggaaugauugugaaugacacgggucaugaaaccgaugagaaccgcgcaaaggucgagaucacaccaaauucccccagagcugaagccacucugggcggguucggaucauugggccucgacugugagccuaggaccggucuggauuuuagugacuuauauuaccugacaaugaacaauaaacacuggcucgugcauaaggaaugguuccacgauauuccacuuccguggcacgcuggggccgacacuggcaccccucauuggaacaauaaagaggcacugguagaauuuaaggaugcccacgcuaaacggcagacaguuguggucuugggaagccaggagggcgcggugcauaccgcacuagccggggcucuggaggccgaaauggacggagcaaagggucgacucuccucuggccaccugaaaugccgccuuaagauggauaagcugagauugaaaggggucagcuauucacucuguacugccgcuuucacguuuacaaagaucccugccgagacccugcauggaacugugaccguugaagugcaguacgcaggcacagacgguccaugcaaaguacccgcgcaaauggcugucgacaugcagaccuuaacuccuguggggaggcugaucacagccaacccaguuauuacggagaguaccgaaaacuccaagaugaugcuagagcucgaucccccguucggcgacagcuacauagugaucggagucggcgagaaaaagauuacucaccacuggcaucggucugggucaacaaucggaaaggcauuugaagccaccgugcgcggugcuaaaagaauggccguacugggcgauacagcaugggacuucgggagugugggaggcgcucuuaauagcuuggguaaggggauacaccagauuuucggcgccgcguuuaaaucccuguucggaggcaugucuugguuuucgcaaauccucaucgggacucugcuuauguggcugggauugaacaccaagaauggcagcauuucccucaugugucuggccuuaggugggguucugaucuuccuaucaacggcugucagugcaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8452 - RNA, 2290 nt, Artificial Sequence
  KY075932.1 prME-short mRNA Design 3 opt
gggagaaagcuuaccaugaccagcgugggcaucgucgggcugcuccuuacaacugccauggcugcagagguuacgagaaggggauccgccuacuauauguaccuggaccggaacgaugcgggugaagcuauuucuuuccccaccacauugggcaugaauaagugcuauauacagaucauggacuuagggcacaugugugaugccacuaugucauacgagugcccuaugcuggacgaaggaguggagccagaugacguagauuguuggugcaacaccacaaguaccuggguggucuauggcacuugucaucacaaaaagggugaagcacgccgaagccguagagccgugacacuaccgucccauucuaccaggaaacuccaaacgcggucgcagacuuggcuggagucacgcgaguacaccaagcaccuuauuagaaucgaaaauuggauuuuuaggaaccccggguucgcucuggcagccgcugccaucgcgugguugcucggaagcaguacaucccagaaaguuauauaucuggugaugauccugcucauugcacccgccuacucuauccggugcauuggcgucagcaaucgcgacuuuguggagggcauguccgggggaacuuggguagauguuguguuagaacaugguggcugugucaccgugauggcucaggacaagccaacaguggauaucgagcuggucaccacgacuguuucaaacauggccgaggugcgaaguuacugcuaugaagcaagcauaucugacauggcuuccgauucaagaugucccacacaaggggaggccuaccuugacaagcagagcgacacccaguauguaugcaaaaggacuuugguggaucggggauggggcaaugguugugggcuguucggaaagggcagucuagucacaugcgcgaaauuugccugcucuaagaaaaugaccggcaaguccauucagccugaaaaccucgaguaccguaucaugcugagcgugcacgggucgcaacacucuggaaugauuguuaaugacacgggucaugaaaccgaugagaaccgcgcaaagguggagaucacaccaaauucccccagagcugaagccacucuuggcggguucggaucacugggcuuggacugugagccuaggaccggucucgauuuuagugaccuguauuacuuaacaaugaacaauaaacacuggcugguccauaaggaaugguuccacgauaucccacucccguggcacgcuggggccgacacuggcaccccucauuggaacaauaaagaggcacuuguggaauuuaaggaugcccacgcuaaacggcagacaguaguugugcugggaagccaggagggcgcgguccauaccgcauuggccggggcucuagaggccgaaauggacggagcaaagggucgacuguccucuggccaccucaaaugccgccugaagauggauaaacuuagacugaagggggugagcuauucauuguguacugccgcuuucacguuuacaaagauuccugccgagacccuccauggaacugucaccguggaaguucaguacgcaggcacagacgguccaugcaaagugcccgcgcaaauggcuguagacaugcagacccugacuccugucgggagguuaauaacagccaacccagugaucacggagaguaccgaaaacuccaagaugaugcuggagcuagaucccccguucggcgacagcuacauuguuaucggagugggcgagaaaaagauaacucaccacuggcaucggucugggucaacaauuggaaaggcauuugaagccaccguccgcggugcuaaaagaauggccgugcucggcgauacagcaugggacuucgggaguguaggaggcgcucugaauagccuugguaaggggauccaccagaucuucggcgccgcguuuaaauccuuguucggaggcaugucuugguuuucgcaaauucugaucgggacucuccugauguggcuuggacugaacaccaagaauggcagcauuuccuugaugugucucgcccugggugggguguuaauauuccugucaacggcuguuagugcaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8453 - RNA, 2290 nt, Artificial Sequence
  KU870645.1 prME-short mRNA Design 3 opt
gggagaaagcuuaccaugaccagcgugggcaucgucgggcugcuccuuacaacugccauggcugcagagguuacgagaaggggauccgccuacuauauguaccuggaccggaacgaugcgggugaagcuauuucuuuccccaccacauugggcaugaauaagugcuauauacagaucauggacuuagggcacaugugugaugccacuaugucauacgagugcccuaugcuggacgaaggaguggagccagaugacguagauuguuggugcaacaccacaaguaccuggguggucuauggcacuugucaucacaaaaagggugaagcacgccgaagccguagagccgugacacuaccgucccauucuaccaggaaacuccaaacgcggucgcagacuuggcuggagucacgcgaguacaccaagcaccuuauuagaguugaaaauuggauccugaggaaccccggguuugcuuuggcagccgcugccauugcguggcuccugggaagcaguacaucccagaaagugaucuaucuggucaugauacucuuaaucgcacccgccuacucuauucggugcaucggcgugagcaaucgcgacuucguagagggcauguccgggggaacuuggguugaugugguccuggaacaugguggcugugugaccgugauggcucaggacaagccaacagucgauauugagcuuguuaccacgacugugucaaacauggccgagguacgaaguuacugcuaugaagcaagcaucucugacauggcuuccgauucaagaugucccacacaaggggaggccuacuuggacaagcagagcgacacccaguaugugugcaaaaggacucuggucgaucggggauggggcaaugguugugggcuauuuggaaagggcagucucgugacaugcgcgaaauucgccugcucuaagaaaaugaccggcaaguccauacagccugaaaaccuggaguaccguauuaugcuuagcguucacgggucgcaacacucuggaaugaucgugaaugacacgggucaugaaaccgaugagaaccgcgcaaaggucgagauuacaccaaauucccccagagcugaagccacucugggcggguuuggaucauugggccucgacugugagccuaggaccggucuggauuucagugacuuauauuaccugacaaugaacaauaaacacuggcucgugcauaaggaaugguuucacgauaucccacuuccguggcacgcuggggccgacacuggcaccccucauuggaacaauaaagaggcacugguagaguucaaggaugcccacgcuaaacggcagacaguuguggucuugggaagccaggaaggcgcggugcauaccgcacuagccggggcucuggaggccgaaauggacggagcaaagggucgacucuccucuggccaccugaaaugccgccuuaagauggauaagcugagauugaaaggggucagcuauucacucuguacugccgcuuuuacguucacaaagaucccugccgagacccugcauggaacugugaccguugaagugcaguacgcaggcacagacgguccaugcaaaguacccgcgcaaauggcugucgacaugcagaccuuaacuccuguggggaggcugauuacagccaacccaguuauaacggagaguaccgaaaacuccaagaugaugcuagagcucgaucccccguuuggcgacagcuacaucgugauuggaaucggcgagaaaaagauaacucaccacuggcaucggucugggucaacaauuggaaaggcauucgaagccaccguccgcggugcuaaaagaauggccgugcugggcgauacagcaugggacuuugggaguguaggaggcgcucuuaauagcuuggguaaggggauccaccagaucuucggcgccgcguucaaaucccuguuuggaggcaugucuugguucucgcaaauucucaucgggacucugcuuauguggcugggauugaacaccaagaauggcagcauuucccucaugugucuggccuuagguggggugcugauauuucuaucaacggcuguuagugcaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8454 - RNA, 2290 nt, Artificial Sequence
  KU729217.2 prME-short mRNA Design 3 opt
gggagaaagcuuaccaugaccagcgugggcaucgucgggcugcuccuuacaacugccauggcugcagagguuacgagaaggggauccgccuacuauauguaccuggaccggaacgaugcgggugaagcuauuucuuuccccaccacauugggcaugaauaagugcuauauacagaucauggacuuagggcacaugugugaugccacuaugucauacgagugcccuaugcuggacgaaggaguggagccagaugacguagauuguuggugcaacaccacaaguaccuggguggucuauggcacuugucaucacaaaaagggugaagcacgccgaagccguagagccgugacacuaccgucccauucuaccaggaaacuccaaacgcggucgcagacuuggcuggagucacgcgaguacaccaagcaccuuauuagaguugaaaauuggaucuuuaggaaccccggguucgcucuggcagccgcugccauugcgugguugcucggaagcaguacaucccagaaagugaucuaucuggucaugauacugcucaucgcacccgccuacucuauucggugcaucggcgugagcaaucgcgacuuuguagagggcauguccgggggaacuuggguugauguggucuuagaacaugguggcugugugaccgugauggcucaggacaagccaacagucgauauugagcugguuucaaccacggugaguaacauggccgagguacgaagcuacugcuaugaagcaacuaucucugacauagcuuccgauucaagaugucccacacaaggggaggccuaccuugacaagcagagcgacacccaguaugugugcaaaaggacuuuggucgaucggggauggggcaaugguugugggcuguucggaaagggcagucuagugacaugcgcgaaauuugccugcucuaagaaaaugaccggcaaguccauucagccugaaaaccucgaguaccguaucaugcugagcguucacgggucgcaacacucuggaaugauugugaaugacacgggucaugaaaccgaugagaaccgcgcaaaggucgagaucacaccaaauucccccagagcugaagccacucuuggcggguucggaucacugggcuuggacugugagccuaggaccggucucgauuuuagugaccuguauuacuuaacaaugaacaauaaacacuggcuggugcauaaggaaugguuccacgauaucccacucccguggcacgcuggggccgacacuggcaccccucauuggaacaauaaagaggcacuuguagaauuuaaggaugcccacgcuaaacggcagacagcgguugugcugggaagccaggagggcgcaguccauaccgccuuggcuggggcccuagaggcagaaauggacggagccaagggucgacuguccucuggccaccucaaaugccgccugaagauggauaaacuuagacugaagggggugagcuauucauuguguacugcugccuucacguuuacaaagauuccugcagagacccuccauggaacugucaccguggaaguucaguacgcgggcacagacgguccaugcaaagugcccgcucaaauggccguagacaugcagacccugacuccugucgggagguuaauaacagcaaacccagugaucacggagaguaccgaaaacuccaagaugaugcuggagcuagaucccccguucggcgacagcuacauuguuaucggagugggcgagaaaaagauaacucaccacuggcaucggucugggucaacaauuggaaaggccuuugaagcuaccguccgcggugccaaaagaauggcagugcucggcgauacagcuugggacuucgggaguguaggaggcgcccugaauagccuugguaaggggauccaccagaucuucggcgcggccuuuaaauccuuguucggaggcaugucuugguuuucgcaaauucugaucgggacucuccugauguggcuuggacugaacaccaagaauggcagcauuuccuugaugugucucgcucugggugggguguuaauauuccugucaacggcaguuagugccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8455 - RNA, 2290 nt, Artificial Sequence
  KX087101.3 prME-short mRNA Design 3 opt
gggagaaagcuuaccaugaccagcgugggcaucgucgggcugcuccuuacaacugccauggcugcagagguuacgagaaggggauccgccuacuauauguaccuggaccggaacgaugcgggugaagcuauuucuuuccccaccacauugggcaugaauaagugcuauauacagaucauggacuuagggcacaugugugaugccacuaugucauacgagugcccuaugcuggacgaaggaguggagccagaugacguagauuguuggugcaacaccacaaguaccuggguggucuauggcacuugucaucacaaaaagggugaagcacgccgaagccguagagccgugacacuaccgucccauucuaccaggaaacuccaaacgcggucgcagacuuggcuggagucacgcgaguacaccaagcaccuuauuagaguugaaaauuggaucuuuaggaaccccggguucgcucuggcagccgcugccauugcgugguugcucggaagcaguacaucccagaaagugaucuaucuggucaugauacugcucaucgcacccgccuacucuauucggugcaucggcgugagcaaucgcgacuuuguagagggcauguccgggggaacuuggguugauguggucuuagaacaugguggcugugugaccgugauggcucaggacaagccaacagucgauauugagcugguuaccacgacugugucaaacauggccgagguacgaaguuacugcuaugaagcaagcaucucugacauggcuuccgauucaagaugucccacacaaggggaggccuaccuugacaagcagagcgacacccaguaugugugcaaaaggacuuuggucgaucggggauggggcaaugguugugggcuguucggaaagggcagucuagugacaugcgcgaaauuugccugcucuaagaaaaugaccggcaaguccauacagccugaaaaccucgaguaccguauuaugcugagcguucacgggucgcaacacucuggaaugaucgugaaugacacgggucaugaaaccgaugagaaccgcgcaaaggucgagauuacaccaaauucccccagagcugaagccacucuuggcggguucggaucacugggcuuggacugugagccuaggaccggucucgauuuuagugaccuguauuacuuaacaaugaacaauaaacacuggcuggugcauaaggaaugguuccacgauaucccacucccguggcacgcuggggccgacacuggcaccccucauuggaacaauaaagaggcacuuguagaauuuaaggaugcccacgcuaaacggcagacaguugugguccugggaagccaggagggcgcggugcauaccgcauuggccggggcucuagaggccgaaauggacggagcaaagggucgacuguccucuggccaccucaaaugccgccugaagauggauaaacuuagacugaagggggucagcuauucauuguguacugccgcuuucacguuuacaaagaucccugccgagacccuccauggaacugugaccguugaacugcaguacgcaggcacagacgguccaugcaaagugcccgcgcaaauggcuguagacaugcagaccuuaacuccugucgggaggcugauuacagccaacccagugauaacggagaguaccgaaaacuccaagaugaugcuagagcucgaucccccguucggcgacagcuacaucguuauuggagugggcgagaaaaagaucacucaccacuggcaucggucugggucaacaauaggaaaggcauuugaagccaccguccgcggugcuaaaagaauggccgugcugggcgauacagcaugggacuucgggaguguaggaggcgcucuuaauagcuuggguaaggggauucaccagaucuucggcgccgcguuuaaaucccuguucggaggcaugucuugguuuucgcaaauccucauugggacucugcuuauguggcugggauugaacaccaagaauggcagcaucucccucaugugucuggccuuagguggggugcugauuuuccuaucaacggcuguuagugcaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8456 - RNA, 2290 nt, Artificial Sequence
  KY014317.1 prME-short mRNA Design 3 opt
gggagaaagcuuaccaugaccagcgugggcaucgucgggcugcuccuuacaacugccauggcugcagagguuacgagaaggggauccgccuacuauauguaccuggaccggaacgaugcgggugaagcuauuucuuuccccaccacauugggcaugaauaagugcuauauacagaucauggacuuagggcacaugugugaugccacuaugucauacgagugcccuaugcuggacgaaggaguggagccagaugacguagauuguuggugcaacaccacaaguaccuggguggucuauggcacuugucaucacaaaaagggugaagcacgccgaagccguagagccgugacacuaccgucccauucuaccaggaaacuccaaacgcggucgcagacuuggcuggagucacgcgaguacaccaagcaccuuauuagaguugaaaauuggaucuuuaggaaccccggguucgcucuggcagccgcugccauugcgugguugcucggaagcaguacaucccagaaagugaucuaucuggucaugauacugcucaucgcacccgccuacucuauucggugcaucggcgugagcaaucgcgacuuuguagagggcauguccgggggaacuuggguugauguggucuuagaacaugguggcugugugaccgugauggcucaggacaagccaacagucgauauugagcugguuaccacgacugugucaaacauggccgagguacgaaguuacugcuaugaagcaagcaucucugacauggcuuccgauucaagaugucccacacaaggggaggccuaccuugacaagcagagcgacacccaguaugugugcaaaaggacuuuggucgaucggggauggggcaaugguugugggcuguucggaaagggcagucuagugacaugcgcgaaauuugccugcucuaagaaaaugaccggcaaguccauacagccugaaaaccucgaguaccguauuaugcugagcguucacgggucgcaacacucuggaaugaucgugaaugacacgggucaugaaaccgaugagaaccgcgcaaaggucgagauuacaccaaauucccccagagcugaagccacucuuggcggguucggaucacugggcuuggacugugagccuaggaccggucucgauuuuagugaccuguauuacuuaacaaugaacaauaaacacuggcuggugcauaaggaaugguuccacgauaucccacucccguggcacgcuggggccgacacuggcaccccucauuggaacaauaaagaggcacuuguagaauuuaaggaugcccacgcuaaacggcagacaguugugguccugggaagccaggagggcgcggugcauaccgcauuggccggggcucuagaggccgaaauggacggagcaaagggucgacuguccucuggccaccucaaaugccgccugaagauggauaaacuuagacugaagggggucagcuauucauuguguacugccgcuuucacguuuacaaagaucccugccgagacccuccauggaacugugaccguugaagugcaguacgcaggcacagacgguccaugcaaaguacccgcgcaaauggcugucgacaugcagacccugacuccuguggggagguuaauuacagccaacccaguuauaacggagaguaucgaaaacuccaagaugaugcuggagcuagaucccccguucggcgacagcuacauugugaucggagucggcgagaaaaagauaacccaccacuggcaucggucugggucaacuauuggaaaggcauuugaagccacagugcgcggugcuaaaagaauggccguacucggcgauaccgcaugggacuucgggagugugggaggcgcucugaauagccuugguaaggggauccaccagaucuucggcgccgcguuuaaauccuuguucggaggcaugucuugguuuucgcaaauucugaucgggacacuccugauguggcuuggacugaacacuaagaauggcagcauuuccuugaugugucucgcccugggugggguuuuaauauuccugucaaccgcugucagugcaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8457 - RNA, 2290 nt, Artificial Sequence
  KU758876.1 prME-short mRNA Design 3 opt
gggagaaagcuuaccaugaccagcgugggcaucgucgggcugcuccuuacaacugccauggcugcagagguuacgagaaggggauccgccuacuauauguaccuggaccggaacgaugcgggugaagcuauuucuuuccccaccacauugggcaugaauaagugcuauauacagaucauggacuuagggcacaugugugaugccacuaugucauacgagugcccuaugcuggacgaaggaguggagccagaugacguagauuguuggugcaacaccacaaguaccuggguggucuauggcacuugucaucacaaaaagggugaagcacgccgaagccguagagccgugacacuaccgucccauucuaccaggaaacuccaaacgcggucgcagacuuggcuggagucacgcgaguacaccaagcaccuuauuagaguugaaaauuggaucuuuaggaaccccggguucgcucuggcagccgcugccauugcgugguugcucggaagcaguacaucccagaaagugaucuaucuggucaugauacugcucaucgcacccgccuacucuauucggugcaucggcgugagcaaucgcgacuuuguagagggcauguccgggggaacuuggguugauguggucuuagaacaugguggcugugugaccgugauggcucaggacaagccaacagucgauauugagcugguuaccacgacugugucaaacauggccgagguacgaaguuacugcuaugaagcaagcaucucugacauggcuuccgauucaagaugucccacacaaggggaggccuaccuugacaagcagagcgacacccaguaugugugcaaaaggacuuuggucgaucggggauggggcaaugguugugggcuguucggaaagggcagucuagugacaugcgcgaaauuugccugcucuaagaaaaugaccggcaaguccauacagccugaaaaccucgaguaccguauuaugcugagcguucacgggucgcaacacucuggaaugaucgugaaugacacgggucaugaaaccgaugagaaccgcgcaaaggucgagauuacaccaaauucccccagagcugaagccacucuuggcggguucggaucacugggcuuggacugugagccuaggaccggucucgauuuuagugaccuguauuacuuaacaaugaacaauaaacacuggcuggugcauaaggaaugguuccacgauaucccacucccguggcacgcuggggccgacacuggcaccccucauuggaacaauaaagaggcacuuguagaauuuaaggaugcccacgcuaaacggcagacaguugugguccugggaagccaggagggcgcggugcauaccgcauuggccggggcucuagaggccgaaauggacggagucaagggucgacuguccucuggccaccucaaaugccgccugaagauggauaaguuaagacugaaaggggugagcuauucauuguguacugcagccuucacguuuacaaagaucccugcugagacccuccauggaacuguuaccguggaaguacaguacgccggcacagacgguccaugcaaaguccccgcacaaauggcgguggacaugcagacccugacuccuguugggagguuaauuacagcuaacccagugauaacggagaguaccgaaaacuccaagaugaugcuggagcuagaucccccguucggcgacagcuacaucgucauuggagugggcgagaaaaagaucacucaccacuggcaucggucugggucaacaauaggaaaggccuuugaagcaaccguacgcggugccaaaagaauggcugugcucggcgauacagccugggacuucgggaguguuggaggcgcacugaauagccuugguaaggggauucaccagaucuucggcgcugccuuuaaauccuuguucggaggcaugucuugguuuucgcaaauccugauugggacucuccugauguggcuuggacugaacaccaagaauggcagcaucuccuucauguguuuggcgcucggugggguccugauuuuucuuucaacggccgugagugcuugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8458 - RNA, 2290 nt, Artificial Sequence
  KU758874.1 prME-short mRNA Design 3 opt
gggagaaagcuuaccaugaccagcgugggcaucgucgggcugcuccuuacaacugccauggcugcagagguuacgagaaggggauccgccuacuauauguaccuggaccggaacgaugcgggugaagcuauuucuuuccccaccacauugggcaugaauaagugcuauauacagaucauggacuuagggcacaugugugaugccacuaugucauacgagugcccuaugcuggacgaaggaguggagccagaugacguagauuguuggugcaacaccacaaguaccuggguggucuauggcacuugucaucacaaaaagggugaagcacgccgaagccguagagccgugacacuaccgucccauucuaccaggaaacuccaaacgcggucgcagacuuggcuggagucacgcgaguacaccaagcaccuuauuagaguugaaaauuggaucuuuaggaaccccggguucgcucuggcagccgcugccauugcgugguugcucggaagcaguacaucccagaaagugaucuaucuggucaugauacugcucaucgcacccgccuacucuauucggugcaucggcgugagcaaucgcgacuuuguagagggcauguccgggggaacuuggguugauguggucuuagaacaugguggcugugugaccgugauggcucaggacaagccaacagucgauauugagcugguuaccacgacugugucaaacauggccgagguacgaaguuacugcuaugaagcaagcaucucugacauggcuuccgauucaagaugucccacacaaggggaggccuaccuugacaagcagagcgacacccaguaugugugcaaaaggacuuuggucgaucggggauggggcaaugguugugggcuguucggaaagggcagucuagugacaugcgcgaaauuugccugcucuaagaaaaugaccggcaaguccauacagccugaaaaccucgaguaccguauuaugcugagcguucacgggucgcaacacucuggaaugaucgugaaugacacgggucaugaaaccgaugagaaccgcgcaaaggucgagauuacaccaaauucccccagagcugaagccacucuuggcggguucggaucacugggcuuggacugugagccuaggaccggucucgauuuuagugaccuguauuacuuaacaaugaacaauaaacacuggcuggugcauaaggaaugguuccacgauaucccacucccguggcacgcuggggccgacacuggcaccccucauuggaacaauaaagaggcacuuguagaauuuaaggaugcccacgcuaaacggcagacaguugugguccugggaagccaggagggcgcggugcauaccgcauuggccggggcucuagaggccgaaauggacggagcaaaggguaaacuguccucuggccaccucaagugccgacugaagauggauaaacuucgccugaagggggucagcuauucauuguguacugccgcuuucacguuuacaaaaaucccugccgagacccuccauggaacugugaccguugaagugcaguacgcaggcacagacgguccaugcaagguacccgcgcaaauggcugucgacaugcagacccugacuccuguggggagauuaauuacagccaacccaguuauaacggagaguaccgaaaacuccaaaaugaugcuggagcuagaucccccguucggcgacagcuacaucgugauuggagucggcgagaagaagaucacucaccacuggcauaggucugggucaacaauaggaaaagcauuugaagccaccgugcggggugcuaagcgcauggccguacucggcgauacagcaugggacuucgggagugugggaggcgcucugaauagccuugguaaagggauucaccagaucuucggcgccgcguuuaaguccuuguucggaggcaugucuugguuuucgcaaauccugauugggacucuccugauguggcuuggacugaacaccaaaaauggcagcaucuccuugaugugucucgcccugggugggguuuuaauuuuccugucaacggcugucagugcaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8459 - RNA, 2290 nt, Artificial Sequence
  KY317939.1 prME-short mRNA Design 3 opt
gggagaaagcuuaccaugaccagcgugggcaucgucgggcugcuccuuacaacugccauggcugcagagguuacgagaaggggauccgccuacuauauguaccuggaccggaaggaugcgggugaagcuauuucuuuccccaccacauugggcaugaacaaaugcuauauacagaucauggacuuagggcacaugugugaugccacuaugucauacgagugcccuaugcuggacgaaggaguggagccagaugacguagauuguuggugcaauaccacaaguaccuggguggucuauggcacuugucaucacaagaaaggugaagcacgccgaagccguagagccgugacacuaccgucccauucuaccaggaagcuccaaacgcggucgcagacuuggcuggagucacgcgaguacaccaaacaccuuauuagaguugaaaacuggaucuuuaggaaucccggguucgcucuggcagccgcugccauugcgugguugcucggaagcaguacaucccagaaggugaucuaucuggucaugauacugcucaucgcacccgccuacucuauucggugcaucggcgugagcaaccgcgacuuuguagagggcauguccgggggaacuuggguugauguggucuuagaacaugguggcugugugaccgugauggcucaggacaagccaacagucgauauugagcugguuaccacgacugugucaaauauggccgagguacgaaguuacugcuaugaagcaagcaucucugacauggcuuccgauucaagaugucccacacaaggggaggccuaccuugacaaacagagcgacacccaguaugugugcaagaggacuuuggucgaucggggauggggcaacgguugugggcuguucggaaaaggcagucuagugacaugcgcgaaguuugccugcucuaaaaagaugaccggcaaguccauacagccugaaaaucucgaguaccguauuaugcugagcguucacgggucgcaacacucuggaaugaucgugaacgacacgggucaugaaaccgaugagaaucgcgcaaaagucgagauuacaccaaacucccccagagcugaagccacucuuggcggguucggaucacugggcuuggacugugagccuaggaccggucucgauuuuagugaccuguauuacuuaacaaugaauaacaagcacuggcuggugcauaaagaaugguuccacgauaucccacucccguggcacgcuggggccgacacuggcaccccucauuggaauaacaaggaggcacuuguagaauuuaaagaugcccacgcuaagcggcagacaguugugguccugggaagccaggagggcgcggugcauaccgcauuggccggggcucuagaggccgaaauggacggagcaaaaggucgacuguccucuggccaccucaagugccgccugaagauggauaaacuuagacugaagggggucagcuauucauuguguacugccgcuuucacguuuacaaaaaucccugccgagacccuccauggaacugugaccguugaagugcaguacgcaggcacagacgguccaugcaagguacccgcgcaaauggcugucgacaugcagacccugacuccuguggggagguuaauuacagccaauccaguuauaacggagaguaccgaaaacuccaaaaugaugcuggagcuagaucccccguucggcgacagcuacaucgugauuggagucggcgagaagaagaucacucaccacuggcaucggucugggucaacaauaggaaaagcauuugaagccaccgugcgcggugcuaagagaauggccguacucggcgauacagcaugggacuucgggagugugggaggcgcucugaacagccuugguaaagggauucaccagaucuucggcgccgcguuuaaguccuuguucggaggcaugucuugguuuucgcaaauccugauugggacucuccugauguggcuuggacugaauaccaaaaacggcagcaucuccuugaugugucucgcccugggugggguuuuaauuuuccugucaacggcugucagugcaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8460 - RNA, 2290 nt, Artificial Sequence
  KY014314.1 prME-short mRNA Design 3 opt
gggagaaagcuuaccaugaccagcgugggcaucgucgggcugcuccuuacaacugccauggcugcagagguuacgagaaggggauccgccuacuauauguaccuggaccggaacgaugcgggugaagcuauuucuuuccccaccacauugggcaugaauaagugcuauauacagaucauggacuuagggcacaugugugaugccacuaugucauacgagugcccuaugcuggacgaaggaguggagccagaugacguagauuguuggugcaacaccacaaguaccuggguggucuauggcacuugucaucacaaaaagggugaagcacgccgaagccguagagccgugacacuaccgucccauucuaccaggaaacuccaaacgcggucgcagacuuggcuggagucacgcgaguacaccaagcaccuuauuagaguugaaaauuggaucuuuaggaaccccggguucgcucuggcagccgcugccauugcgugguugcucggaagcaguacaucccagaaagugaucuaucuggucaugauacugcucaucgcacccgccuacucuauucggugcaucggcgugagcaaucgcgacuuuguagagggcauguccgggggaacuuggguugauguggucuuagaacaugguggcugugugaccgugauggcucaggacaagccaacagucgauauugagcugguuaccacgacugugucaaacauggccgagguacgaaguuacugcuaugaagcaagcaucucugacauggcuuccgauucaagaugucccacacaaggggaggccuaccuugacaagcagagcgacacccaguaugugugcaaaaggacuuuggucgaucggggauggggcaaugguugugggcuguucggaaagggcagucuagugacaugcgcgaaauuugccugcucuaagaaaaugaccggcaaguccauacagccugaaaaccucgaguaccguauuaugcugagcguucacgggucgcaacacucuggaaugaucgugaaugacacgggucaugaaaccgaugagaaccgcgcaaaggucgagauuacaccaaauucccccagagcugaagccacucuuggcggguucggaucacugggcuuggacugugagccuaggaccggucucgauuuuagugaccuguauuacuuaacaaugaacaauaaacacuggcuggugcauaaggaaugguuccacgauaucccacucccguggcacgcuggggccgacacuggcaccccucauuggaacaauaaagaggcacuuguagaauuuaaggaggcccacgcuaaacggcagacaguugugguccugggaagccaggagggcgcggugcauaccgcauuggccggggcucuagaagccgagauggauggagcaaagggucgacuguccucuggccaccucaaaugccgccugaagauggacaaacuuagacugaaaggggucagcuauucauuguguacugccgcuuucacguuuacaaagaucccugccgaaacccuccauggaacugugaccguugaggugcaguacgcaggcacagaugguccaugcaaaguacccgcgcaaauggcugucgacaugcagacccugacuccuguggggagguuaauuacagccaacccaguuauaacggaaaguaccgagaacuccaagaugaugcuggagcuagaucccccguucggcgacagcuacaucgugauuggagucggcgaaaagaagaucacucaccacuggcaucggucugggucaacaauaggaaaggcauuugaggccaccgugcgcggugcuaaaagaauggccguacucggcgacacagcaugggauuucgggagugugggaggcgcucugaauagccuugguaaggggauucaccagaucuucggcgccgcguuuaaauccuuguucggaggcaugucuugguuuucgcaaauccugauugggacucuccugauguggcuuggacugaacaccaagaauggcagcaucuccuugaugugucucgcccugggugggguuuuaauuuuccugucaacggcugucagugcaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8461 - RNA, 2290 nt, Artificial Sequence
  KX447517.1 prME-short mRNA Design 3 opt
gggagaaagcuuaccaugaccagcgugggcaucgucgggcugcuccuuacaacugccauggcugcagagguuacgagaaggggauccgccuacuauauguaccuggaccggaacgaugcgggugaagcuauuucuuuccccaccacauugggcaugaauaagugcuauauacagaucauggacuuagggcacaugugugaugccacuaugucauacgagugcccuaugcuggacgaaggaguggagccagaugacguagauuguuggugcaacaccacaaguaccuggguggucuauggcacuugucaucacaaaaagggugaagcacgccgaagccguagagccgugacacuaccgucccauucuaccaggaaacuccaaacgcggucgcagacuuggcuggagucacgcgaguacaccaagcaccuuauuagaguugaaaauuggaucuuuaggaaccccggguucgcucuggcagccgcugccauugcgugguugcucggaagcaguacaucccagaaagugaucuaucuggucaugauacugcucaucgccccugcauacucuauucggugcaucggcgugagcaaucgcgacuuuguagagggcauguccgggggaacuuggguugauguggucuuagaacaugguggcugugugaccgugauggcucaggacaagccaacagucgauauugagcugguuaccacgacugugucaaacauggccgagguacgaaguuacugcuaugaagcaagcaucucugacauggcuuccgauucaagaugucccacacaaggggaggccuaccuugacaagcagagcgacacccaguaugugugcaaaaggacuuuggucgaucggggauggggcaaugguugugggcuguucggaaagggcagucuagugacaugcgcgaaauuugccugcucuaagaaaaugaccggcaaguccauacagccugaaaaccucgaguaccguauuaugcugagcguucacgggucgcaacacucuggaaugaucgugaaugacacgggucaugaaaccgaugagaaccgcgcaaaggucgagauuacaccaaauucccccagagcugaagccgcucuuggcggguucggaucacugggcuuggacugugagccuaggacuggucucgauuuuagugaccuguauuacuuaaccaugaacaauaaacacuggcuggugcauaaggaaugguuccacgauaucccacucccguggcacgccggggcagacacaggcacuccccauuggaacaauaaagaggcccuuguagaauuuaaggaugcucacgcgaaacggcagaccguugugguccugggaagccaggagggcgcagugcauacagccuuggcuggggcccuagaggcagaaauggacggagccaagggucgacuguccucuggccaccucaaaugccgccugaagauggauaaacuuagacugaagggggucagcuauucauuguguaccgcugccuucacuuuuacgaagaucccugcagagacacuccauggaaccgugacuguugaagugcaguacgcgggcaccgacgguccaugcaaaguacccgcucaaauggccgucgacaugcagacacugaccccuguggggagguuaauuacugcaaacccaguuauaacagagaguacggaaaacuccaagaugaugcuggagcuagaucccccguucggcgacagcuacaucgugauuggagucggcgagaaaaagaucacccaccacuggcaucggucugggucaacuauaggaaaggccuuugaagcuacagugcgcggugccaaaagaauggcaguacucggcgauaccgcuugggacuucgggagugugggaggcgcccugaauagccuugguaaggggauucaccagaucuucggcgcggccuuuaaauccuuguucggaggcaugucuugguuuucgcaaacacugaucgggacucuccugauguggcuuggacugaacaccaagaauggcagcauuuccuugaugugucucgcucugggugggguuuuaaucuuccugucaacggcagucagugccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8462 - RNA, 2290 nt, Artificial Sequence
  KU926310.1 prME-short mRNA Design 3 opt
gggagaaagcuuaccaugaccagcgugggcaucgucgggcugcuccuuacaacugccauggcugcagagguuacgagaaggggauccgccuacuauauguaccuggaccggaacgaugcgggugaagcuauuucuuuccccaccacauugggcaugaauaagugcuauauacagaucauggacuuagggcacaugugugaugccacuaugucauacgagugcccuaugcuggacgaaggaguggagccagaugacguagauuguuggugcaacaccacaaguaccuggguggucuauggcacuugucaucacaaaaagggugaagcacgccgaagccguagagccgugacacuaccgucccauucuaccaggaaacuccaaacgcggucgcagacuuggcuggagucacgcgaguacaccaagcaccuuauuagaguugaaaauuggaucuuuaggaaccccggguucgcucuggcagccgcugccauugcgugguugcucggaagcaguacaucccagaaagugaucuaucuggucaugauacugcucaucgcacccgccuacucuauucggugcaucggcgugagcaaucgcgacuuuguagagggcauguccgggggaacuuggguugauguggucuuagaacaugguggcugugugaccgugauggcucaggacaagccaacagucgauauugagcugguuaccacgacugugucaaacauggccgagguacgaaguuacugcuaugaagcaagcaucucugacauggcuuccgauucaagaugucccacacaaggggaggccuaccuugacaagcagagcgacacccaguaugugugcaaaaggacuuuggucgaucggggauggggcaaugguugugggcuguucggaaagggcagucuagugacaugcgcgaaauuugccugcucuaagaaaaugaccggcaaguccauacagccugaaaaccucgaguaccguauuaugcugagcguucacgggucgcaacacucuggaaugaucgugaaugacacgggucaugaaaccgaugagaaccgcgcaaaggucgagauuacaccaaauucccccagagcugaagccacucuuggcggguucggaucacugggcuuggacugugagccuaggaccggucucgauuuuagugaccuguauuacuuaacaaugaacaauaaacacuggcuggugcauaaggaaugguuccacgauaucccacucccguggcacgcuggggccgacacuggcaccccucauuggaacaauaaagaggcacuuguagaauuuaaggaugcccacgcuaaacggcagacaguugugguccugggaagccaggagggcgcggugcauaccgcauuggccggggcucuagaggccgaaauggacggagcaaagggucgacuguccucuggccaccucaaaugccgccugaagauggauaaacuuagacugaagggggucagcuauucauuguguacugccgcuuucacguuuacaaagaucccugccgagacccuccauggaacugugaccguugaagugcaguacgcaggcgcggacgguccaugcaaaguacccgcucaaauggccgucgacaugcagacacugaccccuguggggagguuaauuacugcaaacccaguuauaacagagaguacggaaaacuccaagaugaugcuggagcuagaucccccguucggcgacagcuacaucgugauuggagucggcgagaaaaagaucacccaccacuggcaucggucugggucaacuauaggaaaggccuuugaagcuacagugcgcggugccaaaagaauggcaguacucggcgauaccgcuugggacuucgggagugugggaggcgcccugaauagccuugguaaggggauucaccagaucuucggcgcggccuuuaaauccuuguucggaggcaugucuugguuuucgcaaauccugauugggacacuccugauguggcuuggacugaacacuaagaauggcagcaucuccuugaugugucucgcucugggugggguuuuaauuuuccugucaaccgcagucagugccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8463 - RNA, 2290 nt, Artificial Sequence
  KU922923.1 prME-short mRNA Design 3 opt
gggagaaagcuuaccaugaccagcgugggcaucgucgggcugcuccuuacaacugccauggcugcagagguuacgagaaggggauccgccuacuauauguaccuggaccggaacgaugcgggugaagcuauuucuuuccccaccacauugggcaugaauaagugcuauauacagaucauggacuuagggcacaugugugaugccacuaugucauacgagugcccuaugcuggacgaaggaguggagccagaugacguagauuguuggugcaacaccacaaguaccuggguggucuauggcacuugucaucacaaaaagggugaagcacgccgaagccguagagccgugacacuaccgucccauucuaccaggaaacuccaaacgcggucgcagacuuggcuggagucacgcgaguacaccaagcaccuuauuagaguugaaaauuggaucuuuaggaaccccggguucgcucuggcagccgcugccauugcgugguugcucggaagcaguacaucccagaaagugaucuaucuggucaugauacugcucaucgcauuagccuacucuauucggugcaucggcgugagcaaucgcgacuuuguagagggcauguccgggggaacuuggguugaugugguccuggaacaugguggcugugugaccgugauggcucaggacaagccuacagucgauauugagcuuguuaccacgacugugucaaacauggccgagguacgaaguuacugcuaugaagcaagcaucucugacauggcuuccgauucaagauguccaacacaaggggaggccuacuuggacaagcagagcgacacccaguaugugugcaaaaggacucuggucgaucggggauggggcaaugguugugggcuauucggaaagggcagucucgugacaugcgcgaaauuugccugcucuaagaaaaugaccggcaaguccauacagcccgaaaaccuggaguaccguauuaugcuuagcguucacgggucgcaacacucuggaaugaucgugaaugacacgggucaugaaaccgaugagaaccgcgcaaaggucgagauuacaccuaauuccccaagagcugaagccacucugggcggguucggaucauugggccucgacugugagcccaggaccggucuggauuuuagugacuuauauuaccugacaaugaacaauaaacacuggcucgugcauaaggaaugguuccacgauaucccucuuccauggcacgcuggggccgacacuggcaccccgcauuggaacaauaaagaggcacugguagaauuuaaggaugcccacgcuaaacggcagacaguuguggucuugggaagccaggagggcgcggugcauaccgcacuagccggggcucuggaggccgaaauggacggagcaaagggucgacucuccucuggccaccugaaaugccgccuuaagauggauaagcugagauugaaaggggucagcuauucacucuguacugccgcuuucacguuuacaaagauccccgccgagacccugcauggaacugugaccguugaagugcaguacgcaggcacagacgguccuugcaaaguaccagcgcaaauggcugucgacaugcagaccuuaacucccguggggaggcugauuacagccaacccuguuauaacggagaguaccgaaaacuccaagaugaugcuagagcucgauccacccuucggcgacagcuacaucgugauuggagucggcgagaaaaagaucacucaccacuggcaucggucugggucaacaauaggaaaggcauuugaagccaccgugcgcggugcuaaaagaauggccguacugggcgauacagcaugggacuucgggagugugggaggcgcucuuaauagcuuggguaaggggauucaccagaucuucggcgccgcguuuaaaucccuguucggaggcaugucuugguuuucgcaaauccucauugggacucugcuuauguggcugggauugaacaccaagaauggcagcaucucccucaugugucuggccuuaggugggguucugauuuuccuaucaacggcugucagugcaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8464 - RNA, 2290 nt, Artificial Sequence
  KY075937.1 prME-short mRNA Design 3 opt
gggagaaagcuuaccaugaccagcgugggcaucgucgggcugcuccuuacaacugccauggcugcagagguuacgagaaggggauccgccuacuauauguaccuggaccggaacgaugcgggugaagcuauuucuuuccccaccacauugggcaugaauaagugcuauauacagaucauggacuuagggcacaugugugaugccacuaugucauacgagugcccuaugcuggacgaaggaguggagccagaugacguagauuguuggugcaacaccacaaguaccuggguggucuauggcacuugucaucacaaaaagggugaagcacgccgaagccguagagccgugacacuaccgucccauucuaccaggaaacuccaaacgcggucgcagacuuggcuggagucacgcgaguacaccaagcaccuuauuagaguugaaaauuggaucuuuaggaaccccggguucgcucuggcagccgcugccauugcgugguugcucggaagcaguacaucccagaaagugaucuaucuggucaugauacugcucaucgcacccgccuacucuauucggugcaucggcgugagcaaucgcgacuuuguagagggcauguccgggggaacuuggguugauguggucuuagaacaugguggcugugugaccgugauggcucaggacaagccaacagucgauauugagcugguuaccacgacugugucaaacauggccgagguacgaaguuacugcuaugaagcaagcaucucugacaugguguccgauucaagaugucccacacaaggggaggcuuaccuugacaagcagagcgacacccaguaugucugcaaaaggacuuugguggaucggggauggggcaaugguugugggcuguucggaaagggcagucuaguuacaugcgccaaauuugcgugcucuaagaaaaugaccggcaaguccauacagccugaaaaccucgaguaccguauuaugcugagcgugcacgggucgcaacacucuggaaugaucgucaaugacacgggucaugaaaccgaugagaaccgcgccaagguggagauuacaccaaauucccccagagcagaagcuacucuuggcggguucggaucacugggcuuggacugugagccuaggaccggucucgauuuuagugaccuguauuacuuaacaaugaacaauaaacacuggcugguacauaaggaaugguuccacgauaucccacucccguggcacgccggggcugacacuggcaccccucauuggaacaauaaagaggcccuuguugaauuuaaggaugcacacgccaaacggcagacaguggucgugcugggaagccaggagggcgcuguccauaccgcguuggcaggggcccuagaggcugaaauggacggagccaagggucgacuguccucuggccaccucaaaugccgccugaagauggauaaacuuagacugaagggggugagcuauucauuguguacugcagccuucacguuuacaaagaucccugcugagacccuccauggaacuguuaccguggaaguacaguacgccggcacagacgguccaugcaaaguccccgcacaaauggcgguggacaugcagacccugacuccuguugggagguuaauuacagcuaacccagugauaacggagaguaccgaaaacuccaagaugaugcuggagcuagaucccccguucggcgacagcuacaucgucauuggagugggcgagaaaaagaucacucaccacuggcaucggucugggucaacaauaggaaaggccuuugaagcaaccguacgcggugccaaaagaauggcugugcucggcgauacagccugggacuucgggaguguuggaggcgcacugaauagccuugguaaggggauucaccagaucuucggcgcugccuuuaaauccuuguucggaggcaugucuugguuuucgcaaauccugauugggacucuccugauguggcuuggacugaacaccaagaauggcagcaucuccuugaugugucucgcgcuggguggggucuuaauuuuccugucaacggccgugagugcuugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8465 - RNA, 2290 nt, Artificial Sequence
  KY003156.1 prME-short mRNA Design 3 opt
gggagaaagcuuaccaugaccagcgugggcaucgucgggcugcuccuuacaacugccauggcugcagagguuacgagaaggggauccgccuacuauauguaccuggaccggaacgaugcgggugaagcuauuucuuuccccaccacauugggcaugaauaagugcuauauacagaucauggacuuagggcacaugugugaugccacuaugucauacgagugcccuaugcuggacgaaggaguggagccagaugacguagauuguuggugcaacaccacaaguaccuggguggucuauggcacuugucaucacaaaaagggugaagcacgccgaagccguagagccgugacacuaccgucccauucuaccaggaaacuccaaacgcggucgcagacuuggcuggagucacgcgaguacaccaagcaccuuauuagaguugaaaauuggaucuuuaggaaccccggguucgcucuggcagccgcugccauugcgugguugcucggaagcaguacaucccagaaagugaucuaucuggucaugauacugcucaucgcacccgccuacucuauucggugcaucggcauuagcaaucgcgacuuuguggagggcauguccgggggaacuuggguagauguuguguuagaacaugguggcugugucaccgugauggcucaggacaagccaacaguggauaucgagcuggucaccacgacuguuucaaacauggccgaggugcgaaguuacugcuaugaagcaagcauaucugacauggcuuccgauucaagaugucccacacaaggggaggccuaccuugacaagcagagcgacacccaguauguaugcaaaaggacuuugguggaucggggauggggcaaugguugugggcuguucggaaagggcagucuagucacaugcgcgaaauuugccugcucuaagaaaaugaccggcaaguccauucagccugaaaaccucgaguaccguaucaugcugagcgugcacgggucgcaacacucuggaaugauuguuaaugacacgggucaugaaaccgaugagaaccgcgcaaagguggagaucacaccaaauucccccagagcugaagccacucuuggcggguucggaauccugggcuuggacugugagccuaggaccggucucgauuuuucagaccuguauuacuuaacaaugaacaauaaacacuggcugguccauaaggaaugguuccacgauauuccacucccguggcacgcuggggccgacacuggcaccccucauuggaacaauaaagaggcacuuguggaauuuaaggaugcccacgcuaaacggcagacaguaguugugcugggaagucaggagggcgcgguccauaccgcauuggccggggcucuagaggccgaaauggacggagcaaagggucgacugagcuccggccaccucaaaugccgccugaagauggauaaacuuagacugaaaggggugucuuauagcuuguguacugccgcuuucacguuuacaaagauaccugccgagacccuccauggaacugucaccguggaaguucaguacgcaggcacagacgguccaugcaaagugcccgcgcaaauggcuguagacaugcagacccugacuccugucgggagguuaaucacagccaacccagugauuacggagucaaccgaaaacaguaagaugaugcuggagcuagaucccccguucggcgacuccuacaucguuauaggagugggcgagaaaaagauuacucaccacuggcaucggagcgggucuacaaucggaaaggcauuugaagccaccguccgcggugcuaaaagaauggccgugcucggcgauacagcaugggacuucgggucaguaggaggcgcucugaauagucuugguaaggggauccaccagauuuucggcgccgcguuuaagagcuuguucggaggcauguccugguuuucucaaauccugauugggacucuccugauguggcuuggacugaacaccaagaauggcucgaucagcuugaugugucucgcccugggugggguguuaauauuccuguccacggcuguuucagcaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8466 - RNA, 2290 nt, Artificial Sequence
  KU312313.1 prME-short mRNA Design 3 opt
gggagaaagcuuaccaugaccagcgugggcaucgucgggcugcuccuuacaacugccauggcugcagagguuacgagaaggggauccgccuacuauauguaccuggaccggaacgaugcgggugaagcuauuucuuuccccaccacauugggcaugaauaagugcuauauacagaucauggacuuagggcacacuugugaugccaccaugucauacgagugcccuaugcuggacgaaggaguggagccagaugacguagauuguuggugcaacacaaccaguacuuggguggucuauggcacaugucaucacaaaaagggugaagcacgccgaagccguagagccgugacccuaccgucccauucuauuaggaaacuccaaacgcggucgcagacuuggcuggagucacgcgaguacaccaagcaccuuaucagaguugaaaauuggauuuuuaggaaccccggguucgcucuggcagccgcugccaucgcgugguugcucggaagcaguacaucccagaaagugauauaucuggucaugauccugcucauugcacccgccuacucuauccggugcauuggcgugagcaaucgcgacuuuguagagggcauguccgggggaacuuggguugauguggucuuagaacaugguggcugugugaccgugauggcucaggacaagccaacagucgauaucgagcugguuaccacgacugugucaaacauggccgagguacgaaguuacugcuaugaagcaagcauaucugacauggcuuccgauucaagaugucccacacaaggggaggccuaccuugacaagcagagcgacacccaguaugugugcaaaaggacuuuggucgaucggggauggggcaaugguugugggcuguucggaaagggcagucuagugacaugcgcgaaauuugccugcucuaagaaaaugaccggcaaguccauucagccugaaaaccucgaguaccguaucaugcugagcguucacgggucgcaacacucuggaaugauugugaaugacacgggucaugaaaccgaugagaaccgcgcaaaggucgagaucacaccaaauucccccagagcugaagccacucuuggcggguucggaucacugggcuuggacugugagccuaggaccggucucgauuuuagugaccuguauuacuuaacaaugaacaauaaacacuggcuggugcauaaggaaugguuccacgauaucccacucccguggcacgcuggggccgacacuggcaccccucauuggaacaauaaagaggcacuuguagaauuuaaggaugcccacgcuaaacggcagacaguugugguccugggaagccaggagggcgcggugcauaccgcauuggccggggcucuagaggccgaaauggacggagcaaagggucgacuguccucuggccaccucaaaugccgccugaagauggauaaacuuagacugaagggggucagcuauucauuguguacugccgcuuucacguuuacaaagauuccugccgagacccuccauggaacugugaccguugaagugcaguacgcaggcacagacgguccaugcaaaguacccgcgcaaauggcugucgacaugcagacccugacuccuguggggagguuaauaacagccaacccaguuaucacggagaguaccgaaaacuccaagaugaugcuggagcuagaucccccguucggcgacagcuacauugugaucggagucggcgagaaaaagauaacucaccacuggcaucggucugggucaacaauuggaaaggcauuugaagccaccgugcgcggugcuaaaagaauggccguacucggcgauacagcaugggacuucgggagugugggaggcgcucugaauagccuugguaaggggauccaccagaucuucggcgccgcguuuaaauccuuguucggaggcaugucuugguuuucgcaaauucugaucgggacucuccugauguggcuuggacugaacgccaagaauggcagcauuuccuugaugugucucgcucugggugggguuuuaauauuccugucaaccgcagucagugccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8467 - RNA, 2290 nt, Artificial Sequence
  KY075935.1 prME-short mRNA Design 3 opt
gggagaaagcuuaccaugaccagcgugggcaucgucgggcugcuccuuacaacugccauggcugcagagguuacgagaaggggauccgccuacuauauguaccuggaccggaacgaugcgggugaagcuauuucuuuccccaccacauugggcaugaauaagugcuauauacagaucauggacuuagggcacaugugugaugccacuaugucauacgagugcccuaugcuggacgaaggaguggagccagaugacguagauuguuggugcaacaccacaaguaccuggguggucuauggcacuugucaucacaaaaagggugaagcacaacgcagccgacgugccgugacacuaccgucccauucuaccagaaaacuccagacgaggucgcagacuuggcuggagucacgggaguacaccaagcaccuuauucgcguugaaaauuggaucuuuagaaaccccggguucgcucuggcagccgcugccauugcgugguugcucggaagcaguacaucccagaaagugaucuaucuggucaugauacugcucaucgcacccgccuacucuauuaggugcaucggcgugagcaaucgggacuuuguagagggcauguccgggggaacuuggguugauguggucuuagaacaugguggcugugugaccgugauggcucaagacaagccaacagucgauauugagcugguuaccacgacugugucaaacauggccgagguacgcaguuacugcuaugaagcaagcaucucugacauggcuuccgauucacgaugucccacacagggggaggccuaccuugacaagcagagcgacacccaguaugugugcaaaagaacuuuggucgauaggggauggggcaaugguugugggcuguucggaaagggcagucuagugacaugcgcgaaauuugccugcucuaagaaaaugaccggcaaguccauacaaccugaaaaccucgaguaccggauuaugcugagcguucacgggucgcagcacucuggaaugaucgugaaugacacgggucaugaaaccgaugagaaccgugcaaaggucgagauuacaccaaauuccccucgcgcugaagccacucuuggcggguucggaucacugggcuuggacugugagccuagaaccggucucgauuuuagugaccuguauuacuuaacaaugaacaauaaacacuggcuggugcauaaggaaugguuccacgauaucccacucccguggcacgcuggggccgacacuggcacaccccauuggaacaauaaagaggcacuuguagaauuuaaggaugcccacgcuaaaaggcagaccguugugguccugggaagccaggagggcgcggugcauaccgcauuggccggggcucuagaggccgaaauggacggagcaaagggucggcuguccucuggccaccucaaaugccgacugaagauggauaaacuucgccugaagggggucagcuauucauuguguacugccgcuuucacguuuacaaagaucccugccgagacccuccauggaacugugaccguugaagugcaauacgcaggcacagacgguccaugcaaaguacccgcgcagauggcugucgacaugcagacccugacuccuguggggagauuaauuacagccaacccaguuauaacggagaguaccgaaaacuccaagaugaugcuggagcuagaucccccguucggcgacagcuacaucgugauuggagucggcgagaaaaagaucacucaccacuggcauaggucugggucaacaauaggaaaggcauuugaagccaccgugcggggugcuaaacgcauggccguacucggcgauacagcaugggacuucgggagugugggaggcgcucugaauagccuugguaaggggauucaccaaaucuucggcgccgcguuuaaauccuuguucggaggcaugucuugguuuucgcagauccugauugggacucuccugauguggcuuggacugaacaccaagaauggcagcaucuccuugaugugucucgcccugggugggguuuuaauuuuccugucaacggcugucagugcaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8468 - RNA, 2290 nt, Artificial Sequence
  KY014320.1 prME-short mRNA Design 3 opt
gggagaaagcuuaccaugaccagcgugggcaucgucgggcugcuccuuacaacugccauggcugcagagguuacgagaaggggauccgccuacuauauguaccuggaccggaacgaugcgggugaagcuauuucuuuccccaccacauugggcaugaauaagugcuauauacagaucauggacuuagggcacaugugugaugccacuaugucauacgagugcccuaugcuggacgaaggaguggagccagaugacguagauuguuggugcaacaccacaaguaccuggguggucuauggcacuugucaucacaaaaagggugaagcacgccgaagccguagagccgugacacuaccgucccauucuaccaggaaacuccaagcucggucgcagacguggcuggagucacgcgaguacacuaagcaccuuauuagaguugaaaauuggaucuuuaggaaccccggguucgcacuggccgcugccgcgauugcaugguugcucggaagcaguaccucccagaaagugaucuaucuggucaugauacugcucaucgccccugcuuacucuauucggugcaucggcgugagcaaucgcgacuuuguagagggcauguccgggggaacauggguugauguggucuuagaacaugguggcugugugacugugauggcccaggacaagccaaccgucgauauugagcugguuacaaccacggugucaaacauggcagagguacgaaguuacugcuaugaagcuagcaucucugacauggccuccgauucaagaugucccacucaaggggaggcguaccuugacaagcagagcgacacacaguaugugugcaaaaggaccuuggucgaucggggauggggcaaugguugugggcuguucggaaagggcagucuagugacuugcgccaaauuugcaugcucuaagaaaaugacaggcaaguccauacagccugaaaaccucgaguaccguauuaugcugagcguucacgggucgcaacacucuggaaugaucgugaaugacaccggucaugaaacggaugagaaccgcgcuaaggucgagauuaccccaaauucccccagagccgaagcuacacuuggcggguucggaucacugggcuuggacugugagccuaggacuggucucgauuuuagugaccuguauuacuuaaccaugaacaauaaacacuggcuggugcauaaggaaugguuccacgauaucccacucccguggcacgccggggcagacacaggcacuccccauuggaacaauaaagaggcccuuguagaauuuaaggaugcucacgcgaaacggcagaccguugugguccugggaagccaggagggcgcagugcauacagccuuggcuggggcccuagaggcagaaauggacggagccaagggucgacuguccucuggccaccucaaaugccgccugaagauggauaaacuuagacugaagggggucagcuauucauuguguaccgcugccuucacuuuuacgaagaucccugcagagacacuccauggaaccgugacuguugaagugcaguacgcgggcaccgacgguccaugcaaaguacccgcucaaauggccgucgacaugcagacacugaccccuguggggagguuaauuacugcaaacccaguuauaacagagaguacggaaaacuccaagaugaugcuggagcuagaucccccguucggcgacagcuacaucgugauuggagucggcgagaaaaagaucacccaccacuggcaucggucugggucaacuauaggaaaggccuuugaagcuacagugcgcggugccaaaagaauggcaguacucggcgauaccgcuugggacuucgggagugugggaggcgcccugaauagccuugguaaggggauucaccagaucuucggcgcggccuuuaaauccuuguucggaggcaugucuugguuuucgcaaauccugauugggacacuccugauguggcuuggacugaacacuaagaauggcagcaucuccuugaugugucucgcucugggugggguuuuaauuuuccugucaaccgcagucagugccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8469 - RNA, 2290 nt, Artificial Sequence
  KY328290.1 prME-short mRNA Design 3 opt
gggagaaagcuuaccaugaccagcgugggcaucgucgggcugcuccuuacaacugccauggcugcagagguuacgagaaggggauccgccuacuauauguaccuggaccggucugaugcgggugaagcuauuucauuccccaccacauugggcaugaacaagugcuauauacagaucauggacuuagggcacaugugugaugccacuaugaguuacgagugcccuaugcuggacgaaggaguggagccagaugacguagauuguuggugcaauaccacaagcaccuggguggucuauggcacuugucaucacaaaaagggugaagcacgccgaucccguagagccgugacacuaccgucucauucgaccaggaaacuccaaacgcggucacagacuuggcuggagagccgcgaguacaccaagcaccuuauuagaguugaaaacuggaucuuuaggaaucccggguucgcucuggcagccgcugccauugcgugguugcucggaaguuccacaucucagaaagugaucuaucuggucaugauacugcucaucgcacccgccuacagcauucggugcaucggcguguccaaccgcgacuuuguagagggcaugucagggggaacuuggguugauguggucuuagaacaugguggcugugugaccgugauggcucaggacaagccaacagucgauauugagcugguuaccacgacugugaguaauauggccgagguacgaagcuacugcuaugaagcaucuaucuccgacauggcuucagauagcagaugucccacacaaggggaggccuaccuugacaagcagagugacacccaguaugugugcaaaaggacuuuggucgaucggggauggggcaacgguugugggcuguucggaaagggcucucuagugacaugcgcgaaauuugccugcuccaagaaaaugaccggcaagagcauacagccugaaaaucucgaguaccguauuaugcugucgguucacgggucucaacacuccggaaugaucgugaacgacacgggucaugaaaccgaugagaaucgcgcaaaggucgagauuacaccaaacucacccagagcugaagccacucuuggcggguucggaagucugggcuuggacugugagccuaggaccggucucgauuuuagcgaccuguauuacuuaacaaugaauaacaaacacuggcuggugcauaaggaaugguuccacgauaucccacucccguggcacgcuggggccgacacuggcaccccucauuggaauaacaaagaggcacuuguagaauuuaaggaugcccacgcuaaacggcagacaguugugguccugggaucccaggagggcgcggugcauaccgcauuggccggggcucuagaggccgaaauggacggagcaaagggucgacugucuagcggccaccucaaaugccgccugaagauggauaaacuuagacugaaaggggucucauauaguuuguguacugccgcuuucacguuuuccaagaucccugccgagacacuccauggaaccgugacugaagagguucaguacgcaggcaccgacgguccaugcaaagugcccgcgcaaauggcuguagacaugcagacacugaccccugucgggagguuaauuacugccaauccagugauaacagaaagcacggagaacucuaagaugaugcuggagcuagaucccccguucggcgacucauacaucguuauuggagugggcgaaaagaagaucacccaccacuggcaucggagugggagcacuauaggaaaggcauuugaggccacaguccgcggugcuaaaagaauggccgugcucggcgauaccgcaugggacuucggguccguaggaggcgcucugaacucucuugguaaggggauucaccagaucuucggcgccgcguuuaaaucguuguucggaggcaugagcugguuuucccaaauccugauugggacacuccugauguggcuuggacugaauacuaagaacggcucaaucaguuugaugugucucgcccugggugggguguuaauuuuccugucuaccgcuguuagcgcaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8470 - RNA, 2290 nt, Artificial Sequence
  KU681081.3 prME-short mRNA Design 3 opt
gggagaaagcuuaccaugaccagcgugggcaucgucgggcugcuccuuacaacugccauggcugcagagguuacgagaaggggauccgccuacuauauguaccuggaccggucugaugcgggugaagcuauuucauuccccaccacauugggcaugaacaagugcuauauacagaucauggacuuagggcacaugugugaugccacuaugaguuacgagugcccuaugcuggacgaaggaguggagccagaugacguagauuguuggugcaauaccacaagcaccuggguggucuauggcacuugucaucacaaaaagggugaagcacgccgaucccguagagccgugacacuaccgucucauucgaccaggaaacuccaaacgcggucacagacuuggcuggagagccgcgaguacaccaagcaccuuauuagaguugaaaacuggaucuuuaggaaucccggguucgcucuggcagccgcugccauugcgugguugcucggaaguuccacaucucagaaagugaucuaucuggucaugauacugcucaucgccccugcauacagcauucggugcaucggcguguccaaccgcgacuuuguagagggcaugucagggggaacuuggguugauguggucuuagaacaugguggcugugugaccgugauggcucaggacaagccaacagucgauauugagcugguuaccacgacugugaguaauauggccgagguacgaagcuacugcuaugaagcaucuaucuccgacauggcuucagauagcagaugucccacacaaggggaggccuaccuugacaagcagagugacacccaguaugugugcaaaaggacuuuggucgaucggggauggggcaacgguugugggcuguucggaaagggcucucuagugacaugcgcgaaauuugccugcuccaagaaaaugaccggcaagagcauacagccugaaaaucucgaguaccguauuaugcugucgguucacgggucucaacacuccggaaugaucgugaacgacacgggucaugaaaccgaugagaaucgcgcaaaggucgagauuacaccaaacucacccagagcugaagccacucuuggcggguucggaagucugggcuuggacugugagccuaggaccggucucgauuuuagcgaccuguauuacuuaacaaugaauaacaaacacuggcuggugcauaaggaaugguuccacgauaucccacucccguggcacacuggggcugacaccggcacaccccauuggaauaacaaagaggcccuuguagaauuuaaggaugcacacgccaaacggcagaccguugugguccugggaucccaggagggcgcugugcauacugcguuggcaggggcccuagaggcugaaauggacggagccaagggucgacugucuagcggccaccucaaaugccgccugaagauggauaagcugagacugaaaggggucucauauaguuuguguacggcagccuucacauuuaccaagaucccugcugagacucuccauggaaccgugacaguugaagugcaguacgccggcaccgacgguccaugcaaaguacccgcacaaauggcggucgacaugcagacucugacaccuguggggagguuaauuacggcuaauccaguuauaaccgagggcacugaaaacuccaagaugaugcuggagcuagaucccccguucggagacagcuacaucgugauuggcgucggggagaaaaagaucacacaccacuggcaucggucuggaucaaccauagguaaggccuuugaagcaacagugcgcggcgccaaaagaauggcuguacucggggauacugccugggacuucggaagugugggcgguguucugaacagccuugggaagggcauucaccagaucuucggagcagcuuuuaaauccuuguucggcgggaugucuugguuuucgcaaauccugauuggaacccuccugauguggcuuggccugaauacgaagaacgguagcaucuccuugaugugucucgcccuugggggagucuuaauuuuccugucaaccgcggugagugccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8471 - RNA, 2290 nt, Artificial Sequence
  KX827309.1 prME-short mRNA Design 3 opt
gggagaaagcuuaccaugaccagcgugggcaucgucgggcugcuccuuacaacugccauggcugcagagguuacgagaaggggauccgccuacuauauguaccuggaccggucugaugcgggugaagcuauuucauuccccaccacauugggcaugaacaagugcuauauacagaucauggacuuagggcacaugugugaugccacuaugaguuacgagugcccuaugcuggacgaaggaguggagccagaugacguagauuguuggugcaauaccacaagcaccuggguggucuauggcacuugucaucacaaaaagggugaagcacgccgaucccguagagccgugacacuaccgucucauucgaccaggaaacuccaaacgcggucacagacuuggcuggagagccgcgaguacaccaagcaccuuauuagaguugaaaacuggaucuuuaggaaucccggguucgcucuggcagccgcugccauugcgugguugcucggaaguuccacaucucagaaagugaucuaucuggucaugauacugcucaucgcacccgccuacagcauucggugcaucggcguguccaaccgcgacuuuguagagggcaugucagggggaacuuggguugauguggucuuagaacaugguggcugugugaccgugauggcucaggacaagccaacagucgauauugagcugguuaccacgacugugaguaauauggccgagguacgaagcuacugcuaugaagcaucuaucuccgacauggcuucagauagcagaugucccacacaaggggaggccuaccuugacaagcagagugacacccaguaugugugcaaaaggacuuuggucgaucggggauggggcaacgguugugggcuguucggaaagggcucucuagugacaugcgcgaaauuugccugcuccaagaaaaugaccggcaagagcauacagccugaaaaucucgaguaccguauuaugcugucgguucacgggucucaacacuccggaaugaucgugaacgacacgggucaugaaaccgaugagaaucgcgcaaaggucgagauuacaccaaacucacccagagcugaagccacucuuggcggguucggaagucugggcuuggacugugagccuaggaccggucucgauuuuagcgaccuguauuacuuaacaaugaauaacaaacacuggcuggugcauaaggaaugguuccacgauaucccacucccguggcacgcuggggccgacacuggcaccccucauuggaauaacaaagaggcacuuguagaauuuaaggaugcccacgcuaaacggcagacaguugugguccugggaucccaggagggcgcggugcauaccgcauuggccggggcucuagaggccgaaauggacggagcaaagggucgacugucuagcggccaccucaaaugccgccugaagauggauaaacuuagacugaagggggucucauauaguuuguguacugccgcuuucacguuuacaaagaucccugccgagacccuccauggaacugugaccguugaagugcaguacgcaggcacagacgguccaugcaaaguacccgcgcaaauggcugucgacaugcagacccugacuccuguggggagguuaauuacagccaauccaguuauaacggaguccaccgaaaacagcaagaugaugcuggagcuagaucccccguucggcgacucuuacaucgugauuggagucggcgagaaaaagaucacucaccacuggcaucggucagggaguacaauaggaaaggcauuugaagccaccgugcgcggugcuaaaagaauggccguacucggcgauacagcaugggacuucgggagcgugggaggcgcucugaacucccuugguaaggggauucaccagaucuucggcgccgcguuuaaaucuuuguucggaggcaugucgugguuuagccaaauccugauugggacucuccugauguggcuuggacugaauaccaagaacggcuccaucucauugaugugucucgcccugggugggguuuuaauuuuccugaguacggcugucucugcaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8472 - RNA, 2290 nt, Artificial Sequence
  KU955593.1 prME-short mRNA Design 3 opt
gggagaaagcuuaccaugaccagcgugggcaucgucgggcugcuccuuacaacugccauggcuguugaggugacgagaaggggaaacgcauacuauauguaccuggaccgguccgaugccggugaagcgauuucuuuccccaccacaaugggcaugaauaagugcuauauacagaucauggacuuggggcacaugugugaugcuacuaugucauacgagugcccuauguuagacgaaggaguagagccagaugacguggauuguuggugcaacaccacaaguaccugggucguguauggcacuugucaucacaaaaagggugaagcccgccgaagccguagagcaguuacacugccgucccauucuaccaggaaacuacaaacgcggucgcagacuuggcucgagucacgcgaguacaccaagcaccugauuagaguggaaaauuggaucuuuaggaaccccggguucgcccuugcugcagccgcuauugccuggcuguugggaagcaguacaucccagaaagucaucuaucucgugaugauacugcugaucgcgccugcauacucuauucggugcaucggcguaagcaaucgcgacuuuguugagggcauguccgggggaacuuggguggaugucgugcucgaacaugguggcugugugaccgucauggcccaggacaagccaacaguugauauugaguuagugaccacgacuguaucaaacauggcugaggugcgaaguuacugcuaugaagccagcaucucugacauggcauccgauucaagaugucccacacaaggggaggcuuaccuggacaagcagagcgacacccaguaugucugcaaaaggacucuuguggaucggggauggggcaaugguuguggguuguucggaaagggcagucugguuacaugcgccaaauuugcgugcucuaagaaaaugaccggcaaguccauacagccugaaaaccuagaguaccguauuaugcucagcgugcacgggucgcaacacucuggaaugaucgucaaugacacgggucaugaaaccgaugagaaccgcgccaagguggagauuacaccaaauucccccagagcagaagcuacucugggcggguucggaucacuuggccuggacugugagccuaggaccgguuuggauuuuagugaccucuauuaccugacaaugaacaauaaacacugguuaguacauaaggaaugguuccacgauaucccacugccguggcacgccggggcugacacuggcacaccccauuggaacaauaaagaggcccucguugaauuuaaggaugcacacgccaaacggcagaccguggucgugcuuggaagccaggagggcgcuguccauaccgcgcuggcaggggccuuggaggcugaaauggacggagccaagggucgacuauccucuggccaccugaaaugccgccucaagauggauaagcugagacuuaaaggggugagcuauucacuguguacugcagccuucacguuuacaaagaucccugcugagaccuugcauggaacuguuaccguggaaguacaguacgccggcacagacgguccaugcaaaguccccgcacaaauggcgguggacaugcagacccucacuccuguugggaggcugauuacagcuaacccagugauaacggagaguaccgaaaacuccaagaugauguuagagcuggaucccccguucggcgacagcuacaucgucauuggagugggcgagaaaaagaucacucaccacuggcaucggucugggucaacaauaggaaaggccuuugaagcaaccguacgcggugccaaaagaauggcugugcuaggcgauacagccugggacuucgggaguguuggaggcgcacucaauagccuggguaaggggauucaccagaucuucggcgcugccuuuaaaucccuuuucggaggcaugucuugguuuucgcaaaucuugauugggacucugcucgucuggcugggacuuaacaccaagaauggcagcaucucccugauguguuuggcgcucgguggggugcugauuuucuuaucaacggccgugagugcuugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8473 - RNA, 2290 nt, Artificial Sequence
  KY272987.1 prME-short mRNA Design 3 opt
gggagaaagcuuaccaugaccagcgugggcaucgucgggcugcuccuuacaacugccauggcugcagagguuacgagaaggggauccgccuacuauauguaccuggaccggucugaugcgggugaagcuauuucauuccccaccacauugggcaugaacaagugcuauauacagaucauggacuuagggcacaugugugaugccacuaugaguuacgagugcccuaugcuggacgaaggaguggagccagaugacguagauuguuggugcaauaccacaagcaccuggguggucuauggcacuugucaucacaaaaagggugaagcacgccgaucccguagagccgugacacuaccgucucauucgaccaggaaacuccaaacgcggucacagacuuggcuggagagccgcgaguacaccaagcaccuuauuagaguugaaaacuggaucuuuaggaaucccggguucgcucuggcagccgcugccauugcgugguugcucggaaguuccacaucucagaaagugaucuaucuggucaugauacugcucaucgcacccgccuacagcauucggugcaucggcguguccaaccgcgacuuuguagagggcaugucagggggaacuuggguugauguggucuuagaacaugguggcugugugaccgugauggcucaggacaagccaacagucgauauugagcugguuaccacgacugugaguaauauggccgagguacgaagcuacugcuaugaagcaucuaucuccgacauggcuucagauagcagaugucccacacaaggggaggccuaccuugacaagcagagugacacccaguaugugugcaaaaggacuuuggucgaucggggauggggcaacgguugugggcuguucggaaagggcucucuagugacaugcgcgaaauuugccugcuccaagaaaaugaccggcaagagcauacagccugaaaaucucgaguaccguauuaugcugucgguucacgggucucaacacuccggaaugaucgugaacgacacgggucaugaaaccgaugagaaucgcgcaaaggucgagauuacaccaaacucacccagagcugaagccacucuuggcggguucggaagucugggcuuggacugugagccuaggaccggucucgauuuuagcgaccuguauuacuuaacaaugaauaacaaacacuggcuggugcauaaggaaugguuccacgauaucccacucccguggcacgcuggggccgacacuggcaccccucauuggaauaacaaagaggcacuuguagaauuuaaggaugcccacgcuaaacggcagacaguugugguccugggaucccaggagggcgcggugcauaccgcauuggccggggcucuagaggccgaaauggacggagcaaagggucgacugucuagcggccaccucaaaugccgccugaagauggauaaacuuagacugaagggggucucauauaguuuguguacugccgcuuucacguuuacaaagaucccugccgagacccuccauggaacugugaccguugaagugcaguacgcaggcacagacgguccaugcaaaguacccgcgcaaauggcugucgacaugcagacccugacuccuguggggagguuaauuacagccaauccaguuauaacggaguccaccgaaaacagcaagaugaugcuggagcuagaucccccguucggcgacucuuacaucgugauuggagucggcgagaaaaagaucacucaccacuggcaucggucagggaguacaauaggaaaggcauuugaagccaccgugcgcggugcuaaaagaauggccguacucggcgauacagcaugggacuucgggagcgugggaggcgcucugaacucccuugguaaggggauucaccagaucuucggcgccgcguuuaaaucuuuguucggaggcaugucgugguuuagccaaauccugauugggacucuccugauguggcuuggacugaauaccaagaacggcuccaucucauugguuugucucgcccuggguggggucuuaauuuuccugaguacggcugugucugcaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8474 - RNA, 2290 nt, Artificial Sequence
  KY007221.1 prME-short mRNA Design 3 opt
gggagaaagcuuaccaugaccagcgugggcaucgucgggcugcuccuuacaacugccauggcugcagagguuacgagaaggggauccgccuacuauauguaccuggaccggucugaugcgggugaagcuauuucauuccccaccacauugggcaugaacaagugcuauauacagaucauggacuuagggcacaugugugaugccacuaugaguuacgagugcccuaugcuggacgaaggaguggagccagaugacguagauuguuggugcaauaccacaagcaccuggguggucuauggcacuugucaucacaaaaagggugaagcacgccgaucccguagagccgugacacuaccgucucauucgaccaggaaacuccaaacgcggucacagacuuggcuggagagccgcgaguacaccaagcaccuuauuagaguugaaaacuggaucuuuaggaaucccggguucgcucuggcagccgcugccauugcgugguugcucggaaguuccacaucucagaaagugaucuaucuggucaugauacugcucaucgcacccgccuacagcauucggugcaucggcgugaacaaucgcgacuuuguagagggcauguccgggggaacuuggguugauguggucuuagaacaugguggcugugugaccgugauggcucaggacaagccaacagucgauauugagcugguuaccacgacugugucaaacauggccgagguacgaaguuacugcuaugaagcaagcaucucugacauggcuuccgauucaagaugucccacacaaggggaggccuaccuugacaagcagagcgacacccaguaugugugcaaaaggacuuuggucgaucggggauggggcaaugguugugggcuguucggaaagggcagucuagugacaugcgcgaaauuugccugcucuaagaaaaugaccggcaaguccauacagccugaaaaccucgaguaccguauuaugcugagcguucacgggucgcaacacucuggaaugaucgugaaugacacgggucaugaaaccgaugagaaccgcgcaaaggucgagauuacaccaaauucccccagagcugaagccacucuuggcggguucggaucacugggcuuggacugugagccuaggaccggucucgauuuuagugaccuguauuacuuaacaaugaacaauaaacacuggcuggugcauaaggaaugguuccacgauaucccacucccguggcacgcuggggccgacacuggcaccccucauuggaacaauaaagaggcacuuguagaauuuaaggaugcccacgcuaaacggcagacaguugugguccugggaagccaggagggcgcggugcauaccgcauuggccggggcucuagaggccgaaauggacggagcaaagggucgacuguccucuggccaccucaaaugccgccugaagauggauaaacuuagacugaagggggucagcuauucauuguguacugccgcuuucacguuuacaaagaucccugccgagacccuccauggaacugugaccguugaagugcaguacgcaggcacagacgguccaugcaaaguacccgcgcaaauggcugucgacaugcagacccugacuccuguggggagguuaauuacagccaacccaguuauaacggagaguaccgaaaacuccaagaugaugcuggagcuagaucccccguucggcgacagcuacaucgugauuggagucggcgagaaaaagaucacucaccacuggcaucggucugggucaacaauaggaaaggcauuugaagccaccgugcgcggugcuaaaagaauggccguacucggcgauacagcaugggacuucgggagugugggaggcgcucugaauagccuugguaaggggauucaccagaucuucggcgccgcguuuaaauccuuguucggaggcaugucuugguuuucgcaaauccugauugggacucuccugauguggcuuggacugaacaccaagaauggcagcaucuccuugguuugucucgcccuggguggggucuuaauuuuccugucaacggcugugagugcaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8475 - RNA, 2290 nt, Artificial Sequence
  EU545988.1 prME-short mRNA Design 3 opt
gggagaaagcuuaccaugaccagcgugggcaucgucgggcugcuccuuacaacugccauggcuguugaggugacgagaaggggauccgcauacuauauguaccuggaccggucugaugccggugaagcgauuucauuccccaccacauugggcaugaacaagugcuauauacagaucauggacuuagggcacaugugugaugcuacuaugaguuacgagugcccuaugcuggacgaaggaguagagccagaugacguggauuguuggugcaauaccacaagcaccugggucguguauggcacuugucaucacaaaaagggugaagcccgccgaucccguagagcaguuacacuaccgucucauucgaccaggaaacuccaaacgcggucacagacuuggcuggagagccgcgaguacaccaagcaccuuauuagaguggaaaacuggaucuuuaggaaucccggguucgcccuggcugcagccgcuauugccugguugcucggaaguuccacaucucagaaagucaucuaucuggugaugauacugcucaucgcgccugcauacagcauucggugcaucggcguauccaaccgcgacuuuguugagggcaugucagggggaacuuggguggaugucguguuagaacaugguggcugugugaccgucauggcccaggacaagccagcuguugauauugagcuggugacaaccacgguaaguaauauggccgaggugcgaagcuacugcuaugaagcaucuaucuccgacauggcuucagauagcagaugucccacucaaggggaggccuaccuugacaagcagagugacacacaguaugucugcaaaaggaccuugguggaucggggauggggcaacgguugugggcuguucggaaagggcucucuaguuacuugcgcgaaauuugccugcuccaagaaaaugacaggcaagagcauacagccugaaaaucucgaguaccguauuaugcugucggugcacgggucucaacacuccggaaugaucgucaacgacaccggucaugaaacggaugagaaucgcgcaaagguggagauuaccccaaacucacccagagcugaagccacacuuggcggguucggaagucugggcuuggacugugagccuaggacuggucucgauuuuagcgaccuguauuacuuaaccaugaauaacaaacacuggcugguacauaaggaaugguuccacgauaucccacucccguggcacgcuggggccgacacaggcacuccccauuggaauaacaaagaggcacuuguugaauuuaaggaugcccacgcuaaacggcagaccguggucgugcugggaucccaggagggcgcgguccauacagcauuggccggggcucuagaggccgaaauggacggagcaaagggucgacugucuagcggccaccucaaaugccgccugaagauggauaaacuuagacugaagggggugucauauaguuuguguaccgccgcuuucacuuuuacgaagaucccugccgagacacuccauggaaccguuacuguggaaguacaguacgcaggcaccgacgguccaugcaaaguccccgcgcaaauggcuguggacaugcagacacugaccccuguugggagguuaauuacugccaauccagugauaacagaguccacggaaaacagcaagaugaugcuggagcuagaucccccguucggcgacucuuacaucgucauuggagugggcgagaaaaagaucacccaccacuggcaucggucagggaguacuauaggaaaggcauuugaagccacaguacgcggugcuaaaagaauggccgugcucggcgauaccgcaugggacuucgggagcguuggaggcgcucugaacucccuugguaaggggauucaccagaucuucggcgccgcguuuaaaucuuuguucggaggcaugucgugguuuagccaaauccugauugggacacuccuggucuggcuuggacugaauacuaagaacggcuccaucucauugaccugucucgcccugggugggguguuaauuuuccugaguacggcugugucugcaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8476 - RNA, 2290 nt, Artificial Sequence
  KU681082.3 prME-short mRNA Design 3 opt
gggagaaagcuuaccaugaccagcgugggcaucgucgggcugcuccuuacaacugccauggcuguugaggugacgagaaggggauccgcauacuauauguaccuggaccggucugaugccggugaagcgauuucauuccccaccacauugggcaugaacaagugcuauauacagaucauggacuuagggcacaugugugaugcuacuaugaguuacgagugcccuaugcuggacgaaggaguagagccagaugacguggauuguuggugcaauaccacaagcaccugggucguguauggcacuugucaucacaaaaagggugaagcccgccgaucccguagagcaguuacacuaccgucucauucgaccaggaaacuccaaacgcggucacagacuuggcuggagagccgcgaguacaccaagcaccuuauuagaguggaaaacuggaucuuuaggaaucccggguucgcccuggcugcagccgucauugcuugguugcucggaaguuccacaucucagaaagugaucuaucugguaaugauacugcucaucgccccugcguacagcauucggugcaucggcguuuccaaccgcgacuuuguggagggcaugucagggggaacuugggucgaugugguguuagaacaugguggcugugucaccguuauggcacaggacaagccaacaguggauauugagcugguaaccacgacugugaguaauauggccgagguccgaagcuacugcuaugaggcuucuaucuccgacauggccucagauagcagaugucccacacaaggggaagcauaccuugacaagcagagugacacccaguaugugugcaaaaggacuuugguugaucggggauggggcaacgguugugggcuguucggaaagggcucucuagugacaugcgcuaaauuugccugcuccaagaaaaugaccggcaagagcauacagccugaaaaucucgaguaccguauuaugcugucgguccacgggucucaacacuccggaaugaucgugaacgacacgggucaugaaaccgaugagaaucgcgcgaagguagagauuacaccaaacucacccagagccgaagcaacucuuggcggguucggaagucugggcuuggacugugagccuaggaccggucucgauuuuagcgaccuguauuacuuaacaaugaauaacaaacacuggcugguucauaaggaaugguuccacgauaucccacucccguggcacgcuggggccgacacuggcacaccccauuggaauaacaaagaggcucuuguggaauuuaaggaugcccacgcaaaacggcagaccgucgugguccugggaucccaggagggcgccgugcauaccgcuuuggcgggggcacuagaggccgaaauggacggagcuaagggucgacugucuagcggccaccucaaaugccgccugaagauggauaaacuuagacugaaggggguuucauauaguuuguguacugccgcauucacguuuacaaagaucccugccgagacccuccauggaacugugaccguagaaguccaguacgcuggcacagacgguccaugcaaagugcccgcccaaauggcaguugacaugcagacccugacuccuguggggagguuaauuacagcgaauccagucauaacggaguccaccgaaaacagcaagaugaugcuggagcuagaucccccguucggcgacucuuacaucgugauuggaguaggcgagaaaaagaucacucaccacuggcaucggucagggaguacaauaggaaaggcuuuugaagccaccgugcgcggugcaaaaagaauggccguucucggcgauacagcuugggacuucgggagcgucggaggcgcccugaacucccuugguaaggggauucaccagaucuucggcgcagcuuuuaaaucuuuguucggaggcaugucgugguuuagccaaauccugauugggacucuccugguguggcuuggacugaauaccaagaacggcuccaucucauugacgugucucgcccugggugggguguuaauuuuccugaguaccgcggucucugccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8477 - RNA, 2290 nt, Artificial Sequence
  KX601167.1 prME-short mRNA Design 3 opt
gggagaaagcuuaccaugaccagcgugggcaucgucgggcugcuccuuacaacugccauggcuguugaggugacgagaaggggauccgcauacuauauguaccuggaccggucugaugccggugaagcgauuucauuccccaccacauugggcguaaacaagugcuauauacagaucauggacuuagggcacaugugugaugcuacuaugaguuacgagugcccuaugcuggacgaaggaguggagccagaugacgucgauuguuggugcaauaccacaagcaccugggugguuuauggcacuugucaucacaaaaagggugaagcccgccgaucccguagagcagugacacuaccgucucauucgaccaggaaacuccaaacgcggucacagacuuggcuggagagccgcgaguacaccaagcaccuuauuagagucgaaaacuggaucuuuaggaaucccggguucgcccuggcugcagccgcuauugccugguugcucggaaguuccacaucucagaaagugaucuaucugguaaugauacugcucaucgcgccugcauacagcauucggugcaucggcguuuccaaccgcgacuuuguggagggcaugucagggggaacuugggucgaugugguguuagaacaugguggcugugucaccguuauggcccaggacaagccaacaguggauauugagcugguaaccacgacugugaguaauauggcugagguccgaagcuacugcuaugaagccucuaucuccgacauggcaucagauagcagaugucccacacaaggggaggcuuaccuugacaagcagagugacacccaguaugugugcaaaaggacuuugguugaucggggauggggcaacgguugugggcuguucggaaagggcucucuagugacaugcgccaaauuugcgugcuccaagaaaaugaccggcaagagcauacagccugaaaaucucgaguaccguauuaugcugucgguccacgggucucaacacuccggaaugaucgugaacgacacgggucaugaaaccgaugagaaucgcgccaagguagagauuacaccaaacucacccagagcagaagcuacucuuggcggguucggaagucugggcuuggacugugagccuaggaccggucucgauuuuagcgaccuguauuacuuaacaaugaauaacaaacacuggcugguucauaaggaaugguuccacgauaucccacucccguggcacgccggggcugacacuggcacaccccauuggaauaacaaagaggcccuuguggaauuuaaggaugcacacgccaaacggcagaccgucgugguccugggaucccaggagggcgcugugcauaccgcguuggcaggggcccuagaggcugaaauggacggagccaagggucgacugucuagcggccaccucaaaugccgccugaagauggauaaacuuagacugaaggggguuucauauaguuuguguacugcagccuucacguuuacaaagaucccugcugagacccuccauggaacugugaccguagaaguccaguacgccggcacagacgguccaugcaaagugcccgcacaaauggcgguugacaugcagacccugacuccuguggggagguuaauuacagcuaauccagucauaacggaguccaccgaaaacagcaagaugaugcuggagcuagaucccccguucggcgacucuuacaucgugauuggaguaggcgauaaaaagaucacucaccacugguaucggucagggaguacaauaggaaaggccuuugaggcaaccgugcgcggugccaaaagaauggcuguucucggcgacacagccugggauuucgggagcgucggaggcgcacugaacucccuugguaaggggauucaucagaucuucggcgcugccuuuaaaucuuuguucggaggcaugucgugguuuagccaaauccugauugggacucuccugguguggcuuggacugaauaccaagaacggcuccaucucauugacgugucucgcgcugggugggguguuaauuuuccugaguaccgccgucucugcuugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8478 - RNA, 2290 nt, Artificial Sequence
  KX694533.2 prME-short mRNA Design 3 opt
gggagaaagcuuaccaugaccagcgugggcaucgucgggcugcuccuuacaacugccauggcuguugaggugacgagaaggggauccgcauacuauauguaccuggaccggucugaugccgguaaggcgauuucauuccccaccacauugggcguaaacaaaugcuauauacagaucauggacuuagggcacaugugugaugcuacuaugaguuacgaaugcccuaugcuggacgagggaguggaaccagaugacgucgauuguuggugcaauaccacaagcaccugggugguuuauggcacuugucaucacaagaaaggugaggcccgccgaucccguagagcagugacacuaccgucucauucgaccaggaagcuccaaacgcggucacagacuuggcuggaaagccgcgaguacaccaaacaccuuauuagagucgagaacuggaucuuuaggaaucccggguucgcccuggcugcagccgcuauugccugguugcucggaaguuccacaucucagaaggugaucuaucugguaaugauacugcucaucgcgccugcauacagcauucggugcaucggcguuuccaaccgcgacuuuguggaaggcaugucagggggaacuugggucgaugugguguuagagcaugguggcugugucaccguuauggcccaggacaagccaacaguggauauugaacugguaaccacgacugugaguaauauggcugagguccgaagcuacugcuaugaggccucuaucuccgacauggcaucagauagcagaugucccacacaaggggaggcuuaccuugacaaacagagugacacccaguaugugugcaagaggacuuugguugaucggggauggggcaacgguugugggcuguucggaaaaggcucucuagugacaugcgccaaguuugcgugcuccaaaaagaugaccggcaagagcauacagccugaaaaucucgaauaccguauuaugcugucgguccacgggucucaacacuccggaaugaucgugaacgacauuggucaugagacggaugaaaaucgcgccaaaguagagaucaccccaaacucacccagagcagaggcuacacuuggcggguucggaagucugggcuuggacugugaaccuaggacuggucucgauuuuagcgaccuguauuacuuaaccaugaauaacaagcacuggcugguucauaaagagugguuccacgauaucccacucccguggcacgccggggcugacacaggcacuccccauuggaauaacaaggaagcccuuguggaguuuaaagaugcacacgccaagcggcagaccgucgugguccugggaucccaggaaggcgcugugcauacagcguuggcaggggcccuagaggcugagauggacggagccaaaggucgacugucuagcggccaccucaagugccgccugaagauggauaaacuuagacugaaggggguuucauauaguuuguguaccgcagccuucacuuuuacgaaaauuccugcugaaacacuccauggaaccgugacuguagagguccaguacgccggcaccgacgguccaugcaaggugcccgcacaaauggcgguugacaugcagacacugaccccuguggggagguuaauaacugcuaauccagucaucacagaauccacggagaacagcaaaaugaugcuggaacuagaucccccguucggcgacucuuacauugugaucggaguaggcgauaagaagauaacccaccacuggcaucggucagggaguacuauuggaaaagccuuugaggcaacagugcgcggugccaagagaauggcuguucucggcgacaccgccugggauuucgggagcgucggaggcgcacugaacucccuugguaaagggauccaccagaucuucggcgcugccuuuaagucuuuguucggaggcaugucgugguuuagccaaauucugaucgggacacuccugguguggcuuggacugaauacuaaaaacggcuccauuucauugaccugucucgcgcugggugggguguuaauauuccugaguacggccgucucugcuugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8479 - RNA, 2290 nt, Artificial Sequence
  KY288905.1 prME-short mRNA Design 3 opt
gggagaaagcuuaccaugaccagcaucggcauuguggggcugcuccuuacaacugccauggcugcagagauaacgagaaggggauccgccuacuauauguaccuggaccggucugaugcggguaaggcuaucucauucgccaccacauugggcgucaacaaaugccacguucagauuauggacuuagggcauaugugugaugcaacuaugaguuaugaaugccccaugcuggacgagggaguggaaccugaugacguagauuguuggugcaauaccacaagcaccuggguggucuacggcacuugucaccauaagaaaggugaggcccgccgaucccguagagcugugacacuaccaucucacucgaccaggaagcuccaaacgcggucacagacuuggcuggaaagccgcgaguauaccaaacaucuuaucaagguugagaacuggauuuuuagaaauccgggguucacacugguggcagucgccaucgcuugguugcucggaaguuccacuucucagaaggugauauaccugguaaugauccugcucauugcccccgcguauagcaucaggugcauuggcguuuccaaccgggacuuuguggaaggcaugucagggggaaccugggucgaugugguguuagagcacgguggcugugucacaguuauggcacaggacaaaccuaccguggauaucgaacugguaacgacuacagugaguaauauggccgagguccgcagcuacugcuacgaggcuucuauauccgacauggccucagauagccgauguccaacccaaggggaagcauaucuugacaagcagagugacacucaguacgugugcaaaagaacauugguugauaggggauggggcaacgguugugggcuguucggaaagggcucucuagugaccugcgcuaaauuuacgugcuccaagaagaugaccggcaaaagcauucagcccgagaaucucgaauaucggaucaugcugucgguccacgggucucaacauuccggaaugauugugaacgacacaggucacgagacugaugaaaaucgugccaagguagagguuaccccuaacucaccacgcgcggaggccacacuuggcggguucggaagucugggcuuggacugugaacccagaacuggucucgauuuuagcgaccuguacuauuuaaccaugaauaacaaacauuggcuggugcacaaggagugguuccacgauaucccucucccauggcaugcaggggcugacacaggcaccccgcacuggaauaacaaagaagcccuugucgaguuuaaggaugcucaugccaaaaggcagacuguggucgugcugggaucccaggaaggcgcaguucacacggccuuggcuggggcgcuagaggcagagauggacggagccaagggucggcuguucucuggccaucucaagugccgacugaaaauggauaaacuucgccugaagggggugagcuacucauuguguacagcugccuuuaccuucacuaagguacccgcagaaacccuccacggaacagucaccguggagguucaguaugccggcacugacgguccuugcaaagugccagcucaaauggccgucgacaugcagacacugacgcccguggggagauuaaucaccgcaaauccuguaauuacugaaaguacagagaacuccaagaugaugcuggaacuagauccacccuuuggcgacagcuacauagugaucggaguuggcgauaagaaaauuacccaccauuggcacaggucugggucaacaaucggaaaggcguucgaggcuacuguccggggugccaaacgcauggcagugcucggcgacaccgccugggauuucgggagugugggaggcgucuuuaacagccuggguaaggggauacaucagauuuucggcgcugccuuuaaaucccuuuucggaggcaugucuugguuuucgcaaaucuugaucgggacgcugcucguuuggcugggacuuaauaccaagaacggcagcauuucccugacauguuuggcacucgguggggugaugaucuuccugucaacugcugugagugccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8480 - RNA, 2290 nt, Artificial Sequence
  KF268950.1 prME-short mRNA Design 3 opt
gggagaaagcuuaccaugaccagcaucggcauuauagggcugcuccuuacaacugccauggcugcagagaucacgagaaggggauccgccuacuauauguaccuggaccggucugaugcggguaaggcuauuucauucgccaccaacuugggcgugaauaaaugccacguccagaucauggacuuagggcauaugugugaugcaacaaugaguuaugaaugccccaugcuggacgagggaguugaaccugaugacguggauuguuggugcaacacuaccagcacauggguaguguacggcaccugucaccauaagaaaggugaggcccgccgaucccguagagcugucacucuaccaucucacucgacaaggaagcuccaaacccggucacagacguggcuggaaagccgcgaguauacuaaacaucuuauuaagguggagaauuggaucuuuagaaacccgggguucgcacuggccgcuguugccauagcgugguugcucggaaguuccaccucucagaaggugaucuaccuggucaugauucugcucaucgcacccgccuauagcauuaggugcaucggcguguccaaucgggacuuuguagaaggcaugucagggggaacauggguugauguggucuuagagcacgguggcugugugacugugauggcucaggacaaaccuaccgucgauauagaacugguuacaaccacggugaguaacauggccgagguacgcagcuacugcuacgaggcaucuauuuccgacauggcuucagauagccgauguccaacucaaggggaagccuaucuugacaagcagagugacacacaguacgugugcaaaagaaccuuggucgauaggggauggggcaaugguugugggcuguucggaaagggcucucuagugacuugcgcgaaauuuacaugcuccaagaagaugaccggcaaaagcauccagcccgagaaccucgaauaucggauuaugcugucgguucacgggucucaacauuccggaaugaucgugaaugacaucggucacgagacggaugaaaaccgugccaaggucgaggugaccccuaauucaccacgcgcagaggcuacacuuggcggguucggaagucugggcuuggacugugaacccagaacuggucucgauuuuagcgaccuguacuauuuaaccaugaacaauaaacauuggcugguacacaaggagugguuccacgauauuccucucccauggcaugccggggcugacacaggcacuccgcacuggaacaauaaagaagcccuuguugaguuuaaggaugcacaugccaaaaggcagaccguggucgugcugggaucccaggaaggcgcuguccacacagcguuggcaggggcccuagaggcugagauggacggagccaagggucggcuguucucuggccaucucaagugccgacugaaaauggauaaacuucgccugaagggggugagcuacucauuguguaccgcagccuuuacuuucacgaagguucccgcugaaacacuccacggaaccgugacuguagagguccaguaugccggcaccgacgguccuugcaaagugccagcacaaauggcgguugacaugcagacacugacccccguggggagauuaauaacugcuaacccugucaucacagaaaguacggagaacuccaagaugaugcuggaacuagauccacccuuuggcgacagcuacauugugaucggaguaggcgauaagaaaauaacccaccauuggcacaggucugggucaacuauuggaaaggccuucgaggcaacagugcggggugccaaacgcauggcuguucucggcgacaccgccugggauuucgggagugucggaggcguguuuaauagccuggguaagggggugcaucagaucuucggcgcagcuuuuaaaucccuuuucggaggcaugucuugguuuucgcaaaucuugauugggacacugcucgucuggcugggacuuaacacuaagaauggcagcaucucccugaccuguuuggcccucggugggguuaugauuuuccugucaacggcggugagugccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8481 - RNA, 2290 nt, Artificial Sequence
  KF383121.1 prME-short mRNA Design 3 opt
gggagaaagcuuaccaugaccagcaucggcauuauagggcugcuccuuacaacugccauggcugcagagaucacgagaaggggauccgccuacuauauguaccuggaccggucugaugcggguaaggcuauuucauucgccaccacauugggcgugaacaaaugccacguccagaucauggacuuagggcauaugugugaugcaacuaugaguuaugaaugccccaugcuggacgagggaguugaaccugaugacguggauuguuggugcaauaccacaagcaccuggguaguguacggcacuugucaccauaagaaaggugaggcccgccgaucccguagagcugucacacuaccaucucacucgaccaggaagcuccaaacgcggucacagacuuggcuggaaagccgcgaguauaccaaacaucuuauuaagguggagaacuggaucuuuagaaauccgggguucgcacugguugccguggcuauagccugguugcucggaaguuccacaucucagaaggucaucuaccuggugaugauucugcucaucgcgcccgcauauagcauuaggugcaucggcguauccaaccgggacuuuguugaaggcaugucagggggaacuuggguggaugucguguuagagcacgguggcugugugaccgucauggcccaggacaaaccuacaguugauauagaacuggugaccacgacuguaaguaauauggcugaggugcgcagcuacugcuacgaggccucuauuuccgacauggcaucagauagccgauguccaacacaaggggaggcuuaucuugacaagcagagugacacccaguacgucugcaaaagaacuuugguggauaggggauggggcaacgguugugggcuguucggaaagggcucucuaguuacaugcgccaaauuuaccugcuccaagaagaugacgggcaaaagcauccagcccgaaaaucucgaauaucggauuaugcugucggugcacgggucucaacauuccggaaugaucgucaacgacaucggucacgagaccgaugaaaaucgugcgaagguggagguaacaccuaacucaccacgcgccgaggcaacucuuggcggguucggaagucugggcuuggacugugaacccagaaccggucucgauuuuagcgaccuguacuauuuaacaaugaauaacaaacauuggcugguucacaaggagugguuccacgauauuccucucccauggcaugcuggggccgacacuggcaccccgcacuggaauaacaaagaagcucuuguggaguuuaaggaugcccaugcaaaaaggcagacagucgugguccugggaucccaggaaggcgccgugcacaccgcuuuggcgggggcacuagaggccgagauggacggagcuaagggucggcuguucucuggccaucucaagugccgacugaaaauggauaaacuucgccugaaggggguuagcuacucauuguguacugccgcauuuacguucacaaaggugcccgccgaaacccuccacggaacuguaaccgucgaggugcaguaugcuggcacagacgguccuugcaaaguuccagcccaaauggcaguggacaugcagacccugacucccgucgggagauuaauaacagcgaauccugugaucacggaaaguaccgagaacuccaagaugaugcuggaacuagauccacccuuuggcgacagcuacauuguaaucggagugggcgauaagaaaauaacucaccauuggcacaggucugggucaacaauuggaaaggcuuucgaggccaccguucggggugcaaaacgcauggccguccucggcgacacagcuugggauuucgggagugugggaggcguguuuaacagccuggguaaggggauccaucagaucuucggcgccgcauuuaaaucccuuuucggaggcaugucuugguuuucgcaaauuuugaucgggacucugcucgucuggcugggacuuaauaccaagaacggcagcauuucccugacguguuuggcucucggugggguuaugauauuccugucaaccgccgugagugcgugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8482 - RNA, 2272 nt, Artificial Sequence
  KF268949.1 prME-short mRNA Design 3 opt
gggagaaagcuuaccaugaccagcaucggcauuauagggcugcuccuuacaacugccauggcugcagagaucacgagaaggggauccgccuacuauauguaccuggaccggucugaugcggguaaggcuauuucauucgccaccaacuugggcgugaauaaaugccacguccagaucauggacuuagggcauaugugugaugcaacaaugaguuaugaaugccccaugcuggacgagggaguugaaccugaugacguggauuguuggugcaacacuaccagcacauggguaguguacggcaccugucaccauaagaaaggugaggcccgccgaucccguagagcugucacucuaccaucucacucgacaaggaagcuccaaacccggucacagacguggcuggaaagccgcgaguauacuaaacaucuuauuaagguggagaauuggaucuuuagaaacccgggguucgcacuggccgcuguugccauagcgugguugcucggaaguuccaccucucagaaggugaucuaccuggucaugauucugcucaucgcacccgccuauagcauuaggugcaucggcguguccaaucgggacuuuguagaaggcaugucagggggaacauggguugauguggucuuagagcacgguggcugugugacugugauggcucaggacaaaccuaccgucgauauagaacugguuacaaccacggugaguaacauggccgagguacgcagcuacugcuacgaggcaucuauuuccgacauggcuucagauagccgauguccaacucaaggggaagccuaucuugacaagcagagugacacacaguacgugugcaaaagaaccuuggucgauaggggauggggcaaugguugugggcuguucggaaagggcucucuagugacuugcgcgaaauuuacaugcuccaagaagaugaccggcaaaagcauccagcccgagaaccucgaauaucggauuaugcugucgguucacgggucucaacauuccggaaugaucgugaaugacgagaaccgugccaaggucgaagugacgccuaauucaccacgcgcagaggcuacccuugguggcuucgggagucugggauuggauugugagcccagaacaggccucgacuuuagcgaucuguacuauuuaacuaugaacaauaaacacuggcugguacauaaggaaugguuccacgacaucccucucccauggcacgccggugcugauaccgggacaccgcauuggaacaauaaagaggcccuuguugaauuuaaggacgcacacgccaaaaggcagacuguggucgugcugggcucccaggagggagcuguccauaccgcguuggcaggcgcccuagaagcugagauggauggggccaagggacggcuguucucuggucaccucaagugccgacugaaaauggacaaacuucgccugaagggcgugagcuacucauuguguacagcagccuuuaccuucacuaagguucccgcugagacgcuccaugggacagugaccguagaaguccaguaugccggaacugauggcccuugcaaagugccagcacaaauggcgguugacaugcagacccugacacccguggguagauuaauuaccgcuaacccugucauaacugagaguacagaaaacuccaagaugaugcuggagcuagacccacccuuuggggauagcuacaucgugauuggcguaggagacaagaaaaucacgcaccacuggcauaggucuggcucaaccauagggaaggccuucgaagcaacugugcggggagccaaacgcauggcuguucucggugauacagccugggacuucggcagugucgggggaguguuuaauagccugggcaaggguauucaccagaucuucggggcagcuuuuaaaucccuuuucggcggaaugucuugguuuucgcaaaucuugauuggcacccugcucguguggcuggggcuuaacacaaagaauggaagcaucucccugacuuguuuggcccucggcggugucaugauuuuccugucaaccgcgguuagugccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8483 - RNA, 2290 nt, Artificial Sequence
  KU955595.1 prME-short mRNA Design 3 opt
gggagaaagcuuaccaugaccagcaucggcauuguggggcugcuccuuacaacugccauggcugcagagauaacgagaaggggauccgccuacuauauguaccuggaccggucugaugcggguaaggcuaucucauucgccaccacauugggcgucaacaaaugccacguucagauuauggacuuagggcauaugugugaugcaacuaugaguuaugaaugccccaugcuggacgagggaguggaaccugaugacguagauuguuggugcaauaccacaagcaccuggguggucuacggcacuugucaccauaagaaaggugaggcccgccgaucccguagagcugugacacuaccaucucacucgaccaggaagcuccaaacgcggucacagacuuggcuggaaagccgcgaguauaccaaacaucuuaucaagguugagaacuggauuuuuagaaauccgggguucgcacugguggccgucgcuaucgccugguugcucggaaguuccacaucucagaaggugauauaccugguaaugauccugcucauugcgcccgcauauagcaucaggugcauuggcguuuccaaccgggacuuuguggaaggcaugucagggggaacuugggucgaugugguguuagagcacgguggcugugucaccguuauggcccaggacaaaccuacaguggauaucgaacugguaaccacgacugugaguaauauggcugagguccgcagcuacugcuacgaggccucuauauccgacauggcaucagauagccgauguccaacacaaggggaggcuuaucuugacaagcagagugacacccaguacgugugcaaaagaacuuugguugauaggggauggggcaacgguugugggcuguucggaaagggcucucuagugacaugcgccaaauuuaccugcuccaagaagaugacgggcaaaagcauucagcccgaaaaucucgaauaucggaucaugcugucgguccacgggucucaacauuccggaaugauugugaacgacaccggucacgagacagaugaaaaucgugcgaagguagagguuacuccuaacucaccacgcgccgaggcaacccuuggcggguucggaagucugggcuuggacugugaacccagaacaggucucgauuuuagcgaccuguacuauuuaacuaugaauaacaaacauuggcuggugcacaaggagugguuccacgauaucccucucccauggcaugcuggggccgacaccggcacaccgcacuggaauaacaaagaagcucuugucgaguuuaaggaugcccaugcaaaaaggcagaccguggucgugcugggaucccaggaaggcgccguucacacugcuuuggcgggggcacuagaggccgagauggacggagcuaagggucggcuguucucuggccaucucaagugccgacugaaaauggauaaacuucgccugaagggggugagcuacucauuguguacggccgcauuuacauucaccaagguacccgccgaaacucuccacggaaccgucacaguggagguucaguaugcuggcaccgacgguccuugcaaagugccagcccaaauggcagucgacaugcagacucugacacccguggggagauuaaucacggcgaauccuguaauuaccgaaaguacugagaacuccaagaugaugcuggaacuagauccacccuuuggcgacagcuacauagugaucggaguuggcgauaagaaaauuacacaccauuggcacaggucugggucaaccaucggaaaggcuuucgaggccacaguccggggugcaaaacgcauggccgugcucggcgacacugcuugggauuucgggagugugggaggcgucuuuaacagccuggguaaggggauacaucagauuuucggcgccgcauuuaaaucccuuuucggaggcaugucuugguuuucgcaaaucuugaucgggacccugcucguuuggcugggacuuaauacgaagaacggcagcauuucccugaccuguuuggcucucgguggggugaugaucuuccugucaacagccgugagugcgugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8484 - RNA, 2290 nt, Artificial Sequence
  KF383116.1 prME-short mRNA Design 3 opt
gggagaaagcuuaccaugaccagcaucggcauuguggggcugcuccuuacaacugccauggcugcagagauaacgagaaggggauccgccuacuauauguaccuggaccggucugaugcggguaaggcuaucucauucgccaccacauugggcgucaacaaaugccacguucagauuauggacuuagggcauaugugugaugcaacuaugaguuaugaaugccccaugcuggacgagggaguggaaccugaugacguagauuguuggugcaauaccacaagcaccuggguggucuacggcacuugucaacacaagaaaggugaggcccgccgaucccguagagcugugacacuaccaucucauucgaccaggaagcuccagacgcggucacagacuuggcuggaaagccgcgaguauaccaaacaccuuaucaagguugagaacuggauuuuuagaaauccgggguucgcacugguggccgucgcuaucgccugguugcucggaaguuccacaucucagaaggugauauaccugguaaugauccugcucauugcgcccgcauauagcaucaggugcauuggcguuuccaaccgggacuuuguggaaggcaugucagggggaacuugggucgaugugguguuagagcaugguggcugugucaccguuauggcccaagacaaaccuacaguggauaucgaacugguaaccacgacugugaguaauauggcugagguccgcagcuacugcuacgaggccucuauauccgacauggcaucagauagccgauguccaacacagggggaggcuuaucuugacaagcagagugacacccaguacgugugcaaaagaacuuugguugauaggggauggggcaacgguugugggcuguucggaaagggcucucuagugacaugcgccaaauuuaccugcuccaagaagaugacgggcaaaagcauucaacccgaaaaucucgaauaucggaucaugcugucgguccacgggucucagcacuccggaaugauugugaacgacaucggucaugagaccgaugaaaaucgugcgaagguagagguuacaccuaacucaccacgcgccgaggcaacucuuggcggguucggaagucugggcuuggacugugaacccagaaccggucucgauuuuagcgaccuguacuauuuaacaaugaauaacaaacacuggcuggugcauaaggagugguuccacgauaucccucucccauggcacgcuggggccgacacuggcaccccgcauuggaauaacaaagaagcucuugucgaguuuaaggaugcccacgcaaaaaggcagacaguggucgugcugggaucccaggaaggcgccguucauaccgcuuuggcgggggcacuagaggccgagauggacggagcuaagggucggcuguucucuggccaccucaagugccgacugaaaauggauaaacuucgccugaagggggugagcuacucauuguguacugccguaugcacggcagccaagguccccgcugaaacacuccauggaaccgugacuguugaggugcaauaugccggcaccgacgguccuuguaaagucccagcacagauggcgguggacaugcagacacugacccccguagggagauuaauuacugcuaauccugugauaacagaaaguacggagaacuccaagaugaugcuggaacuagauccacccuuuggcgacagcuacaucguuauuggagucggcgauaagaaaaucacccaccacuggcauaggucugggucaacuauaggaaaggccuucgaggcaacagugcggggugccaaacgcauggcugugcucggcgacaccgccugggauuuugggagugucggaggcguuuucaacagccuggguaaggggauucaccaaaucuucggcgcagcuuuuaaaucccuuuucggaggcaugucuugguuuucgcagaucuugauugggacacugcucguguggcugggacuuaauacuaagaacggcagcaucucccugaccugcuuggcccucgguggggugaugauuuuccugucaacggcgguaagugccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8485 - RNA, 2272 nt, Artificial Sequence
  KX601166.1 prME-short mRNA Design 3 opt
gggagaaagcuuaccaugaccagcaucggcauuguggggcugcuccuuacaacugccauggcugcagagauaacgagaaggggauccgccuacuauauguaccuggaccggucugaugcggguaaggcuaucucauucgccaccacauugggcgucaacaaaugccacguucagauuauggacuuagggcauaugugugaugcaacuaugaguuaugaaugccccaugcuggacgagggaguggaaccugaugacguagauuguuggugcaauaccacaagcaccuggguggucuacggcacuugucaccauaagaaaggugaggcccgccgaucccguagagcugugacacuaccaucucacucgaccaggaagcuccaaacgcggucacagacuuggcuggaaagccgcgaguauaccaaacaucuuaucaagguugagaacuggauuuuuagaaauccgggguucgcacugguggccgucgcuaucgccugguugcucggaaguuccacaucucagaaggugauauaccugguaaugauccugcucauugcgcccgcauauagcaucaggugcauuggcguuuccaaccgggacuuuguggaaggcaugucagggggaacuugggucgaugugguguuagagcacgguggcugugucaccguuauggcccaggacaaaccuacaguggauaucgaacugguaaccacgacugugaguaauauggcugagguccgcagcuacugcuacgaggccucuauauccgacauggcaucagauagccgauguccaacacaaggggaggcuuaucuugacaagcagagugacacccaguacgugugcaaaagaacuuugguugauaggggauggggcaacgguugugggcuguucggaaagggcucucuagugacaugcgccaaauuuaccugcuccaagaagaugacgggcaaaagcauucagcccgaaaaucucgaauaucggaucaugcugucgguccacgggucucaacauuccggaaugauugugaacgacgagaaucgugcgaagguagaaguuaccccuaacucaccacgcgccgaggcaacacuugguggcuucgggagucugggauuggauugugagcccagaacuggccucgacuuuagcgaucuguacuauuuaaccaugaauaacaaacacuggcuggugcauaaggaaugguuccacgacaucccucucccauggcacgcuggugccgauacagggacuccgcauuggaauaacaaagaggcucuugucgaauuuaaggacgcccacgcaaaaaggcagaccguggucgugcugggcucccaggagggagccguucauacagcuuuggcgggcgcacuagaagccgagauggauggggcuaagggacggcuguucucuggucaccucaagugccgacugaaaauggacaaacuucgccugaagggcgugagcuacucauuguguaccgccgcauuuacuuucacgaagguacccgccgagacacuccaugggaccgucacuguggaaguucaguaugcuggaaccgauggcccuugcaaagugccagcccaaauggcagucgacaugcagacacugacccccguggguagauuaaucacugcgaauccuguaauuacagagaguacggaaaacuccaagaugaugcuggagcuagacccacccuuuggggauagcuacauagugaucggcguuggagacaagaaaauuacccaccacuggcauaggucuggcucaacuaucgggaaggcuuucgaagccacaguccggggagcaaaacgcauggccgugcucggugauaccgcuugggacuucggcagugucgggggaguguuuaacagccugggcaaggguauacaccagauuuucggggccgcauuuaaaucccuuuucggcggaaugucuugguuuucgcaaaucuugaucggcacacugcucguuuggcuggggcuuaauacuaagaacggaagcauuucccugaccuguuuggcucucggcggugugaugaucuuccugucaacggccgugagugcgugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8486 - RNA, 2290 nt, Artificial Sequence
  KF383118.1 prME-short mRNA Design 3 opt
gggagaaagcuuaccaugaccagcaucggcauuauagggcugcuccuuacaacugccauggcugcagagaucacgagaaggggauccgccuacuauauguaccuggaccggucugaugcggguaaggcuauuucauucgccaccacauugggcgugaacaaaugccacguccagaucauggacuuagggcauaugugugaugcaacuaugaguuaugaaugccccaugcuggacgagggaguugaaccugaugacguggauuguuggugcaauaccacaagcaccuggguaguguacggcacuugucaccauaagaaaggugagacacgccgaucccguagaucugucucgcuaagguaucacuacacccggaagcuccaaacgcgcucacagacuuggcuggaaagcagagaguauaaaaagcaucuuauuaugguggagaacuggaucuuuaggaauccaggguucgccauaguuaguguggcuaucaccuggcugaugggauccuugacaucucagaaggucauuuaccucgugaugaucguacugauuguuccggcauacagcaucuccugcauaggcgugucaaaccgggaccuggucgaaggcaugagugggggaacuuggguggaugugguccucgagcacgguggcuguguuaccgaaauggcccaggacaaacccacaguggauauugaguuaguaaccaugacggugagcaauauggcugagguccgcucuuauugcuacgaagccucccugucagacauggcgagcgcaagucgauguccuacucaaggggagccaucucuugauaagcaguccgacacacagagcgugugcaaaagaaccuugggagacaggggcugggguaacggguguggaaucuuuggcaagggcucgcugguuacuugcucuaaauucacaugcuguaagaagaugcccgggaaauccauucagccugaaaaucuagaguaucggaucaugcucccagugcacggaucacaacauagugguaugaucgucaacgauauuggccacgaaaccgacgagaaucgugccaagguggagguaacgcccaacagcccucgcgcugaagccacccugggaggguuuggcucccuuggucuggauugcgagccaagaacaggguuggacuucucugaucucuacuaucugacuaugaauaacaaacauugguuaguucacaaggaaugguuucacgacauaccgcugcccuggcaugcaggcgcugauaccggaacaccucacuggaauaacaaagaggcccucguggaguucaaggacgcgcaugccaaaaggcagacugucgugguccuuggcagccaggaaggggcagugcacaccgcucuggccggagcuuuggaggccgaaauggauggugcaaagggccggcuauuuucagggcaucugaagugucgacucaaaauggacaagcugcgccuuaaaggaguuaguuacucccugugcacagccgcuuucaccuuuacuaaggugccagcggagacguugcacggcacaguaaccgucgaagugcagagcgcagguacugaugggcccuguaaaguuccugcccaaauggcuguggacaugcagacccucacaccagucggcagacugaucaccgccaaucccgugauuacugagucuacagaaaacucaaagaugauguuagagcuggacccgccuuucggagauaguuauaucguaauaggcgugggggacaagaaaauuacgcaccauuggcacaggagcggauccaccaucgguaaggcauuugaggccacuguucggggcgcuaaacgcauggccguccuaggggauacagcaugggacuucggaucugugggcgguguguucaacucgcucgggaagggcauccaucagauuuuuggagcggcuuucaaaagccuguuuggcgggauguccugguucucacaaauccuuauuggaaccuugcuggucuggcucggccugaauacaaagaacgguaguauaucucuuacuugccuggcccucgggggaguuaugaucuuuuugagcaccgcaguguccgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8487 - RNA, 2287 nt, Artificial Sequence
  KX447520.1 prME-short mRNA Design 3 opt
gggagaaagcuuaccaugagcgugggcaucgucgggcugcuccuuaccacagccauggcugcagagguuacuagaaggggauccgccuacuauauguaccuggaccggaacgaugcgggugaagcuauuucuuuccccacgaccuugggcaugaauaagugcuauauacagaucauggacuuagggcacaugugugaugccacaaugucauacgagugcccuaugcuggacgaaggaguggagccagaugacguagauuguuggugcaacacuaccaguacauggguggucuauggcaccugucaucacaaaaagggugaagcacgccgaagccguagagccgugacucuaccgucccauucuacaaggaaacuccaaacccggucgcagacguggcuggagucacgcgaguacacuaagcaccuuauuagaguugaaaauuggaucuuuaggaaccccggguucgcucuggcagccgcugccauugcgugguugcucggaagcaguaccucccagaaagugaucuaucuggucaugauacugcucaucgccccugcauacucuauucggugcaucggcgugagcaaucgcgacuuuguagagggcauguccgggggaacauggguugauguggucuuagaacaugguggcugugugacugugauggcucaggacaagccaaccgucgauauugagcugguuacaaccacggugucaaacauggccgagguacgaaguuacugcuaugaagcaagcaucucugacauggcuuccgauucaagaugucccacucaaggggaggccuaccuugacaagcagagcgacacacaguaugugugcaaaaggaccuuggucgaucggggauggggcaaugguugugggcuguucggaaagggcagucuagugacuugcgcgaaauuugccugcucuaagaaaaugacaggcaaguccauacagccugaaaaccucgaguaccguauuaugcugagcguucacgggucgcaacacucuggaaugaucgugaaugacaccggucaugaaacggaugagaaccgcgcaaaggucgagauuaccccaaauucccccagagcugaagccacacuuggcggguucggaucacugggcuuggacugugagccuaggacuggucucgauuuuagugaccuguauuacuuaaccaugaacaauaaacacuggcuggugcauaaggaaugguuccacgauaucccacucccguggcacgcuggggccgacacaggcacuccccauuggaacaauaaagaggcacuuguagaauuuaaggaugcccacgcuaaacggcagaccguugugguccugggaagccaggagggcgcggugcauacagcauuggccggggcucuagaggccgaaauggacggagcaaagggucgacuguccucuggccaccucaaaugccgccugaagauggauaaacuuagacugaagggggucagcuauucauuguguaccgccgcuuucacuuuuacgaagaucccugccgagacacuccauggaaccgugacuguugaagugcaguacgcaggcaccgacgguccaugcaaaguacccgcgcaaauggcugucgacaugcagacacugaccccuguggggagguuaauuacugccaacccaguuauaacagagaguacggaaaacuccaagaugaugcuggagcuagaucccccguucggcgacagcuacaucgugauuggagucggcgagaaaaagaucacccaccacuggcaucggucugggucaacuauaggaaaggcauuugaagccacagugcgcggugcuaaaagaauggccguacucggcgauaccgcaugggacuucgggagugugggaggcgcucugaauagccuugguaaggggauucaccagaucuucggcgccgcguuuaaauccuuguucggaggcaugucuugguuuucgcaaauccugauugggacacuccugauguggcuuggacugaacacuaagaauggcagcaucuccuugaugugucucgcccugggugggguuuuaauuuuccugucaaccgcugucagugcaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8488 - RNA, 2290 nt, Artificial Sequence
  KU761561.1 prME-short mRNA Design 3 opt
gggagaaagcuuaccaugaccagcgugggcaucgucgggcugcuccuuacaacugccauggcugcagagguuacgagaaggggauccgccuacuauauguaccuggaccggaacgaugcgggugaagcuauuucuuuccccaccacauugggcaugaauaagugcuauauacagaucauggacuuagggcacaugugugaugccacuaugucauacgagugcccuaugcuggacgaaggaguggagccagaugacguagauuguuggugcaacaccacaaguaccuggguggucuauggcacuugucaucacaaaaagggugaagcacgccgaagccguagagccgugacacuaccgucccauucuaccaggaaacuccaaacgcggucgcagacuuggcuggagucacgcgaguacaccaagcaccuuauuagaguugaaaauuggaucuuuaggaaccccggguucgcucuggcagccgcugccauugcgugguugcucggaagcaguacaucccagaaagugaucuaucuggucaugauacugcucaucgcacccgccuacucuauucggugcaucggcgugagcaaucgcgacuuuguagagggcauguccgggggaacuuggguugauguggucuuagaacaugguggcugugugaccgugauggcucaggacaagccaacagucgauauugagcugguuaccacgacugugucaaacauggccgagguacgaaguuacugcuaugaagcaagcaucucugacauggcuuccgauucaagaugucccacacaaggggaggccuaccuugacaagcagagcgacacccaguaugugugcaaaaggacuuuggucgaucggggauggggcaaugguugugggcuguucggaaagggcagucuagugacaugcgcgaaauuugccugcucuaagaaaaugaccggcaaguccauacagccugaaaaccucgaguaccguauuaugcugagcguucacgggucgcaacacucuggaaugaucgugaaugacacgggucaugaaaccgaugagaaccgcgcaaaggucgagauuacaccaaauucccccagagcugaagccacucuuggcggguucggaucacugggcuuggacugugagccuaggaccggucucgauuuuagugaccuguauuacuuaacaaugaacaauaaacacuggcuggugcauaaggaaugguuccacgauaucccacucccguggcacgcuggggccgacacuggcaccccucauuggaacaauaaagaggcacuuguagaauuuaaggaugcccacgcuaaacggcagacaguugugguccugggaagccaggagggcgcggugcauaccgcauuggccggggcucuagaggccgaaauggacggagcaaagggucgacuguccucuggccaccucaaaugccgccugaagauggauaaacuuagacugaagggggucagcuauucauuguguacugccgcuuucacguuuacaaagaucccugccgagacccuccauggaacugugaccguugaagugcaguacgcaggcacagacgguccaugcaaaguacccgcgcaaauggcugucgacaugcagacccugacuccuguggggagguuaauuacagccaacccaguuauaacggagaguaccgaaaacuccaagaugaugcuggagcuagaucccccguucggcgacagcuacaucgugauuggagucggcgagaaaaagaucacucaccacuggcaucggucugggucaacaauaggaaaggcauuugaagccaccgugcgcggugcuagaaggauggccguacucggcgauacagcaugggacuucgggagugugggaggcgcucugaauagccuugguaaagggauucaccagaucuucggcgccgcguuuaaguccuuguucggaggcaugucuugguuuucgcaaauccugauugggacucuccugauguggcuuggacugaacaccaaaaauggcagcaucuccuugaugugucucgcccugggugggguuuuaauuuuccugucaacggcugucagugcaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8489 - RNA, 2290 nt, Artificial Sequence
  KX806557.2 prME-short mRNA Design 3 opt
gggagaaagcuuaccaugaccagcgugggcaucgucgggcugcuccuuacaacugccauggcugcagagguuacgagaaggggauccgccuacuauauguaccuggaccggaacgaugcgggugaagcuauuucuuuccccaccacauugggcaugaauaagugcuauauacagaucauggacuuagggcacaugugugaugccacuaugucauacgagugcccuaugcuggacgaaggaguggagccagaugacguagauuguuggugcaacaccacaaguaccuggguggucuauggcacuugucaucacaaaaagggugaagcacgccgaagccguagagccgugacacuaccgucccauucuaccaggaaacuccaaacgcggucgcagacuuggcuggagucacgcgaguacaccaagcaccuuauuagaguugaaaauuggauguuuaggaaccccggguucgcucuggcagccgcugccaucgcgugguugcucggaagcaguacaucccagaaagugauuuaucuggucaugauccugcucauagcacccgccuacucuauccggugcauuggcgugagcaaucgcgacuuuguagagggcauguccgggggaacuuggguugauguggucuuagaacaugguggcugugugaccgugauggcucaggacaagccaacagucgauaucgagcugguuaccacgacugugucaaacauggccgagguacgaaguuacugcuaugaagcaagcauuucugacauggcuuccgauucaagaugucccacacaaggggaggccuaccuugacaagcagagcgacacccaguaugugugcaaaaggacuuuggucgaucggggauggggcaaugguugugggcuguucggaaagggcagucuagugacaugcgcgaaauuugccugcucuaagaaaaugaccggcaaguccauccagccugaaaaccucgaguaccguauaaugcugagcguucacgggucgcaacacucuggaaugauugugaaugacacgggucaugaaaccgaugagaaccgcgcaaaggucgagaucacaccaaauucccccagagcugaagccacucuuggcggguucggaucacugggcuuggacugugagccuaggaccggucucgauuuuagugaccuguauuacuuaacaaugaacaauaaacacuggcuggugcauaaggaaugguuccacgauauuccacucccguggcacgcuggggccgacacuggcaccccucauuggaacaauaaagaggcacuuguagaauuuaaggaugcccacgcuaaacggcagacaguugugguccugggaagccaggagggcgcggugcauaccgcauuggccggggcucuagaggccgaaauggacggagcaaagggucgacuguccucuggccaccucaaaugccgccugaagauggauaaacuuagacugaagggggucagcuauucauuguguacugccgcuuucacguuuacaaagaucccugccgagacccuccauggaacugugaccguugaagugcaguacgcaggcacagacgguccaugcaaaguacccgcgcaaauggcugucgacaugcagacccugacuccuguggggagguuaaucacagccaacccaguuauuacggagaguaccgaaaacuccaagaugaugcuggagcuagaucccccguucggcgacagcuacauagugaucggagucggcgagaaaaagauuacucaccacuggcaucggucugggucaacaaucggaaaggcauuugaagccaccgugcgcggugcuaaaagaauggccguacucggcgauacagcaugggacuucgggagugugggaggcgcucugaauagccuugguaaggggauacaccagauuuucggcgccgcguuuaaauccuuguucggaggcaugucuugguuuucgcaaauccugaucgggacucuccugauguggcuuggacugaacaccaagaauggcagcauuuccuugaugugucucgcccugggugggguuuuaaucuuccugucaacggcugucagugcaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8490 - RNA, 2290 nt, Artificial Sequence
  LC191864.1 prME-short mRNA Design 3 opt
gggagaaagcuuaccaugaccagcgugggcaucgucgggcugcuccuuacaacugccauggcugcagagguuacgagaaggggauccgccuacuauauguaccuggaccggaacgaugcgggugaagcuauuucuuuccccaccacauugggcaugaauaagugcuauauacagaucauggacuuagggcacaugugugaugccacuaugucauacgagugcccuaugcuggacgaaggaguggagccagaugacguagauuguuggugcaacaugaccaguacauggguggucuauggcaccugucaucacaaaaagggugaagcacgccgaagccguagagccgugacucuaccgucccauucuacaaggaaacuccaaacccggucgcagacguggcuggagucacgcgaguacacuaagcaccuuauuagaguugaaaauuggaucuuuaggaaccccggguucgcucuggcagccgcugccauugcgugguugcucggaagcaguaccucccagaaagugaucuaucuggucaugauacugcucaucgccccugcauacucuauucggugcaucggcgugagcaaucgcgacuuuguagagggcauguccgggggaacauggguugauguggucuuagaacaugguggcugugugacugugauggcucaggacaagccaaccgucgauauugagcugguuacaaccacggugucaaacauggccgagguacgaaguuacugcuaugaagcaagcaucucugacauggcuuccgauucaagaugucccacucaaggggaggccuaccuugacaagcagagcgacacacaguaugugugcaaaaggaccuuggucgaucggggauggggcaaugguugugggcuguucggaaagggcagucuagugacuugcgcgaaauuugccugcucuaagaaaaugacaggcaaguccauacagccugaaaaccucgaguaccguauuaugcugagcguucacgggucgcaacacucuggaaugaucgugaaugacaccggucaugaaacggaugagaaccgcgcaaaggucgagauuaccccaaauucccccagagcugaagccacacuuggcggguucggaucacugggcuuggacugugagccuaggacuggucucgauuuuagugaccuguauuacuuaaccaugaacaauaaacacuggcuggugcauaaggaaugguuccacgauaucccacucccguggcacgcuggggccgacacaggcacuccccauuggaacaauaaagaggcacuuguagaauuuaaggaugcccacgcuaaacggcagaccguugugguccugggaagccaggagggcgcggugcauacagcauuggccggggcucuagaggccgaaauggacggagcaaagggucgacuguccucuggccaccucaaaugccgccugaagauggauaaacuuagacugaagggggucagcuauucauuguguaccgccgcuuucacuuuuacgaagaucccugccgagacacuccauggaaccgugacuguugaagugcaguacgcaggcaccgacgguccaugcaaaguacccgcgcaaauggcugucgacaugcagacacugaccccuguggggagguuaauuacugccaacccaguuauaacagagaguacggaaaacuccaagaugaugcuggagcuagaucccccguucggcgacagcuacaucgugauuggagucggcgagaaaaagaucacccaccacuggcaucggucugggucaacuauaggaaaggcauuugaagccacagugcgcggugcuaaaagaauggccguacucggcgauaccgcaugggacuucgggagugugggaggcgcucugaauagccuugguaaggggauucaccagaucuucggcgccgcguuuaaauccuuguucggaggcaugucuugguuuucgcaaauccugauugggacacuccugauguggcuuggacugaacacuaagaauggcagcaucuccuugaugugucucgcccugggugggguuuuaauuuuccugucaaccgcugucagugcaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8491 - RNA, 2290 nt, Artificial Sequence
  KU744693.1 prME-short mRNA Design 3 opt
gggagaaagcuuaccaugaccagcgugggcaucgucgggcugcuccuuacaacugccauggcugcagagguuacgagaaggggauccgccuacuauauguaccuggaccggaacgaugcgggugaagcuauuucuuuccccaccacauugggcaugaauaagugcuauauacagaucauggacuuagggcacaugugugaugccacuaugucauacgagugcccuaugcuggacgaaggaguggagccagaugacguagauuguuggugcaacaccacaaguaccuggguggucuauggcacuugucaucacaaaaagggugaagcacgccgaagccguagagccgugacacuaccgucccauucuaccaggaaacuccaaacgcggucgcagacuuggcuggagucacgcgaguacaccaagcaccuuauuagaguugaaaauuggaucuuuaggaaccccggguucgcucuggcagccgcugccauugcgugguugcucggaagcaguacaucccagaaagugaucuaucuggucaugauacugcucaucgcacccgccuacucuauucggugcaucggcgugagcaaucgcgacuuuguagagggcauguccgggggaacuuggguugauguggucuuagaacaugguggcugugugaccgcuauggcccaggacaagccaacaguggauauugagcuggucaccacgacuguuucaaacauggcagaggugcgaaguuacugcuaugaagcuagcaucucugacauggccuccgauucaagaugucccacacaaggggaggcguaccuugacaagcagagcgacacccaguauguaugcaaaaggacuuugguggaucggggauggggcaaugguugugggcuguucggaaagggcagucuagucacaugcgccaaauuugcaugcucuaagaaaaugaccggcaaguccauacagccugaaaaccucgaguaccguauuaugcugagcgugcacgggucgcaacacucuggaaugcuuguuaaugacacgggucaugaaaccgaugagaaccgcgcuaagguggagaucacaccaaauucccccagagccgaagcuacucugggcggguucggaucauugggccucgacugugagccuaggaccggucuggauuuuagugacuuauauuaccugacaaugaacaauaaacacuggcucgcccauaaggaaugguuccacgauauuccacuuccguggcacgcaggggccgcuacuggcaccccucauuggaacaauaaagaggcgcuggucgaauuuaaggacgcacacgccaaacggcagacagugguaguuuugggaagccaggagggcgcugugcauaccgcccuagcaggggcccuggaggcugaaauggauggagccaagggucgacucuccucuggccaccugaaaugccgccuuaagauggacaagcugagauugaaaggggucagcuauucacucuguacugcagcguucacguuuacaaagaucccugcugagaccguggauggaacugucaccguggaaggccaguacggugggacagacggcccaugcaaaguucccgcccaaauggcaguggacaugcagacccugacuccuguaggaagguuaaucacagccaacccagucauuacggagaguaccgaaaacuccaagaugaugcuggagcuagaucccccguucggcgacagcuacauagugaucgggguuggagagaaaaagauuacucaucacuggcaccggucugguucaacaaucggcaaggcuuuugaagccaccgugcgcggggcaaaaagaauggcuguccucggagauacagccugggacuucggcaguguggguggggcgcugaauagccuuggcaagggaauacaucagauuaucggcgccgcuuucaaauccuuguuugggggaaugucuugguucucgcaaauccugauuggcacucuccugauguggcuuggucugaacaccaagaaugggagcaucuccuugaugugucucgcacugggaggcguauuaauuuuucugucaacggccgugagugguugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8492 - RNA, 2281 nt, Artificial Sequence
  KU963574.2 prME-short mRNA Design 3 opt
gggagaaagcuuaccaugggcgccgacgcuagcaucgggauugugucccugcuccuuaccacagucauggcagccgagauaacuagaaggggaucugcguacuauauguaccuggaucggucagacgcugguaaggccaucaguuucguuacgaccuugggcgugaacaaaugccacguacagauuauggauuuagggcauaugugugacgcaacaaugagcuaugaaugccccaugcuggaugagggaguggaaccugacgaugucgacuguuggugcaauacuaccuccacaugggugguuuacggcaccugucaccauaagaaaggugaggcccgccgaucucguagagcugugacucuaccaucgcacucaacaaggaagcuccaaacccggagccagacguggcuggaaagucgcgaguauacuaaacaucuuaucaaggucgagaacuggauuuuuagaaauccgggguucgcacugguggccguagcuaucgccugguugcucggauccucuaccagccagaagguuauauaccuggugaugauccugcucauugcgcccgcauauuccaucaggugcauuggcgucucaaaccgggauuuuguggaaggcaugagugggggaacauggguggacgucguuuuagagcacgguggcugugugacuguaauggcccaggauaaaccuaccguggacaucgaacuggucacaaccacggugagcaauauggcugagguucgcucuuacugcuacgaggccuccauaucagauauggcaagcgacagucgauguccaacucaaggggaggcuuaucuugacaagcagucugauacacaguacgugugcaaaagaaccuuggucgacaggggauggggcaacgguugugggcuguucggaaagggcucccuagugacuugcgccaaauuuacaugcagcaagaagaugaccggcaaaucgauucagcccgaaaaucucgaauaucggaucaugcugucuguacacgggucccaacauucaggaaugauuguuaacgaugagaaucgugcgaagguggaagucacgccuaacaguccacgcgccgaggcaacccuugguggcuucgggagccugggauuggacugugagcccagaacaggccucgauuuuuccgaccuguacuauuuaacuaugaauaacaaacacuggcuggugcauaaggaaugguuccacgauaucccucucccauggcacucuggugcugacaccgagacaccgcauuggaauaacaaagaagcccuugucgaguuuaaggaugcucacgccaaaaggcagacugugguugugcuggggagccaggaaggcgcaguacauaccgccuuggcuggagcgcuagaggcagagauggacggcgccaaggggcggcugucaaguggacaccucaagugccgacugaaaauggauaaacuucgccugaagggugucuccuacagcuuguguacagcugccuucaccuuuacuaaggugcccgcagaaacgcuccauggcacaguuaccguggagguccaguaugccgggagagacggaccuugcaaagugccagcucaaauggccguagacaugcagacucugacccccgugggcagguuaaucacagcaaauccuguuauuaccgaaucuacugagaacucaaagaugaugcuggaacuagauccacccuucggugacaguuacauagucaucggggugggcgauaagaaaauuacacaccacuggcaucggagcggauccaucauaggcaaggcguuugaggcuacggugcgcggggccaaaagaauggcaguccucggagacaccgccugggauuucgguucuguuggcgggguguucaacucgcugggaaagggcauucaccagaucuuuggugcugccuucaaaagccuuuuugggggcauguccugguucucacaaaucuugauuggaacucugcucguguggcugggccuuaauacaaagaacgggaguaucucucugaccuguuuggcacucggaggcguaaugauuuuucugagcacagcugucuccgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8493 - RNA, 2299 nt, Artificial Sequence
  KF383120.1 prME-short mRNA Design 3 opt
gggagaaagcuuaccaugggcgccgacaccagcaucgggauuauaggacugcuccuuacaacugcuauggcagccgagaucacgagaagggguuccgcguacuauauguaccuggaucggucugacgcuggcaaggccauuucauucgcaaccacaaugggggugaacaaaugccacguccagaucauggauuugggacauaugugugacgccacuaugaguuaugaaugccccauguuagaugagggcguugaaccugacgauguggacuguuggugcaauaccacaagcaccuggguaguguacgguacuugucaccauaagaaaggggaggcucgcccaucccgacgugcagucacacugccgucucacucgaccagaaagcuacaaacgaggucacagacuuggcucgaaagccgggaguauaccaaacaucugauuaagguggagaacuggauccuucgcaaucccggauuuacaguugccgcucuggccauggcgugguugcucggcaacaguacuucccagagagugauauaccuggucaugauccugcucauugcacccgccuauucuaucaggugcauuggcgugagcaaucgggauuucguagaagggauguccggagguaccuggguugacguggucuuagagcacggcgggugugugacagugauggcucaggauaagccaaccgucgacaucgaacugguuacgacuacagugucaaacauggccgagguacgcaguuacugcuacgaggcaagcauaucugauauggcuuccgacucacgaugucccacccaaggagaagccuaucuugacaaacagagcgauacucaguacgugugcaagagaacauuggucgacaggggcugggguaauggguguggacuguuuggcaaaggcagucuagugaccugcgcgaaguucacgugcucuaaaaagaugaccgggaaguccauucagccugagaaccucgaauaucggaucaugcugagcguucacggaucgcaacauucugguaugauugugaaugauaucggccacgagacagacgaaaaccgugccaaagucgaggugacuccaaauuccccucgcgcagaggcuacccuugggggauuuggcucacuggguuuggauugugaaccuagaacagggcucgacuucagugaucuguacuauuuaacuaugaacaauaagcauuggcugguacacaaagagugguuucacgacaucccacucccguggcaugccggcgcugauaccggaacaccccacuggaacaauaaggaagcccuuguugaguucaaagacgcacaugccaagaggcagaccguggucgugcugggcagccaggaaggggcuguccacacugcguuggcaggagcccuagaggcugagauggauggugccaaaggccggcuguuuuccgggcaucucaagugccgaauuaagauggacaaacugcgccuuaagggagugucuuacagccuguguacggcagccuucacauuuucaaaaguuccugcugaaaccuugcacggcacugugaccguagagguccaguaugccgguagagacgggccaugcaaggugcccgcacaaauggcgguugauaugcagacacucaccccugugggcaggcugauaacugcuaacccaaucauuacagaaaguacggagaacucccggaugauguuagaacuggaucccccguucggagacagcuacaucgucauaggcgugggggacaaaaagauuacccaccauuggcaccgcucuggaucaacuaucgguaaggccuuugaggcaacaguaagaggcgccaaaaggauggcugugcuaggggauaccgccugggacuucggaaguguuggcggugucuucaauagccucgggaagggcgugcaucagguguuuggagcagcuuucaaaucccuguuuggcgggaugucuugguucucgcaaauccuuauuggaacauugcuggucuggcucggccugaacacuaagaaugguagcaucucccuugccugucuggcguugggaggggccaugauuuuucucucaaccgcuguuagugcaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8494 - RNA, 1582 nt, Artificial Sequence; identical to SEQ ID NO: 8269
  KU321639.1 solE mRNA Design 3 opt

SEQ ID NO: 8495 - RNA, 1582 nt, Artificial Sequence; identical to SEQ ID NO: 8270
  KU312312.1 solE mRNA Design 3 opt

SEQ ID NO: 8496 - RNA, 1570 nt, Artificial Sequence; identical to SEQ ID NO: 8271
  AY632535.2 solE mRNA Design 3 opt

SEQ ID NO: 8497 - RNA, 1582 nt, Artificial Sequence; identical to SEQ ID NO: 8270
  KU527068.1 solE mRNA Design 3 opt

SEQ ID NO: 8498 - RNA, 1582 nt, Artificial Sequence
  KX421193.1 solE mRNA Design 3 opt
gggagaaagcuuaccaugagccagaaggugaucuaccuggucaugauucuccuuauagcccccgcuuauuccaucagaugcauuggcguuucuaacagggacuucguggaggggaugucaggagguaccuggguagaugugguccuggaacacggcgggugugugacaguuauggcacaagacaaaccuacuguggauaucgaguuggucacgaccacagugaguaauauggccgaaguacggagcuacugcuaugaggcguccauuucugacauggcuucggauucacgcuguccaacucagggagaagccuacuuagacaagcagagcgauacccaguauguuugcaaacgaacacugguggaccguggcugggguaacggguguggacuauuuggcaagggcagucucgugaccugcgcaaaauucacuuguuccaagaagaugacagggaaaucuauccaaccggagaaucuggaguacagaauaaugcuuagcguccauggaucccagcacucagguaugaucgugaacgauaccggcuaugaaacggacgagaauagggccaaggucgaaguuacucccaacaguccucgggcugaggcaacccugggaggguuuggcagcuugggucucgauugcgagccacgcacagggcuggacuucucugaucuguacuaccucacuaugaauaacaaacauugguuagugcacaaggaaugguuucaugacauuccccugccuuggcacgccggagcugacaccggcacaccacacuggaauaacaaagaggcccuuguagaguucaaggaugcgcaugcaaagagacagaccguggucguguugggcucccaggaaggggccguucacacggcucuggccggagcacuagaagcugagauggacggugccaaaggcaagcucuuuucagggcaucugaaauguaggcuuaagauggauaaacugcgguugaagggagugagcuauagucucugcacugcggccuucacauuuaccaaaguccccgcagagacucugcacggcacagugaccguagaaguucaauacgcugguacggacgggccuuguaagaucccagugcagauggccgucgauaugcagaccuuaacaccggugggccgccugauuacugcuaaucccgucaucaccgagucuacagaaaacuccaagaugaugcucgagcuugacccuccauucggagauagcuauauagugauuggcguuggggacaaaaagaucacucaccauuggcaccgaucgggaucuaccauugguaaagccuuugaagcaacagugagaggcgccaagaggauggcuguacugggggauaccgcgugggacuucggauccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8499 - RNA, 1582 nt, Artificial Sequence
  LC002520.1 solE mRNA Design 3 opt
gggagaaagcuuaccaugagccagaaggugaucuaccuggucaugauucuccuuauagcccccgcuuauuccaucagaugcauuggcguuucuaacagggacuucguggaggggaugucaggagguaccuggguagaugugguccuggaacacggcgggugugugacaguuauggcacaagacaaaccuacuguggauaucgaguuggucacgaccacagugaguaauauggccgaaguacggagcuacugcuaugaggcguccauuucugacauggcuucggauucacgcuguccaacucagggagaagccuacuuagacaagcagagcgauacccaguauguuugcaaacgaacacugguggaccguggcugggguaacggguguggacuauuuggcaagggcagucucgugaccugcgcaaaauucacuuguuccaagaagaugacagggaaaucuauccaaccggagaaucuggaguacagaauaaugcuuagcguccauggaucccagcacucagguaugaccgugaacgauaucggcuaugaaacggacgagaauagggccaaggucgaaguuacucccaacaguccucgggcugaggcaacccugggaggguuuggcagcuugggucucgauugcgagccacgcacagggcuggacuucucugaucuguacuaccucacuaugaauaacaaacauugguuagugcacaaggaaugguuucaugacauuccccugccuuggcacgccggagcugacaccggcacaccacacuggaauaacaaagaggcccuuguagaguucaaggaugcgcaugcaaagagacagaccguggucguguugggcucccaggaaggggccguucacacggcucuggccggagcacuagaagcugagauggacggugccaaaggcaagcucuuuucagggcaucugaaauguaggcuuaagauggauaaacugcgguugaagggagugagcuauagucucugcacugcggccuucacauuuaccaaaguccccgcagagacucugcacggcacagugaccguagaaguucaauacgcugguacggacgggccuuguaagaucccagugcagauggccgucgauaugcagaccuuaacaccggugggccgccugauuacugcuaaucccgucaucaccgagucuacagaaaacuccaagaugaugcucgagcuugacccuccauucggagauagcuauauagugauuggcguuggggacaaaaagaucacucaccauuggcaccgaucgggaucuaccauugguaaagccuuugaagcaacagugagaggcgccaagaggauggcuguacugggggauaccgcgugggacuucggauccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8500 - RNA, 1564 nt, Artificial Sequence
  DQ859059.1 solE mRNA Design 3 opt
gggagaaagcuuaccaugagccagaaggugaucuaccuggucaugauucuccuuauagcccccgcuuauuccaucagaugcauuggcguuucuaacagggacuucguggaggggaugucaggagguaccuggguagaugugguccuggaacacggcgggugugugacaguuauggcacaagacaaaccuacuguggauaucgaguuggucacgaccacagugaguaauauggccgaaguacggagcuacugcuaugaggcguccauuucugacauggcuucggauucacgcuguccaacucagggagaagccuacuuagacaagcagagcgauacccaguauguuugcaaacgaacacugguggaccguggcugggguaacggguguggacuauuuggcaagggcagucucgugaccugcgcaaaauucacuuguuccaagaagaugacagggaaaucuauccaaccggagaaucuggaguacagaauaaugcuuagcguccauggaucccagcacucagguaugaucgugaacgaugaaaauagggccaaggucgagguuacccccaacaguccucgggcugaagcaacgcugggcggguuuggcagcuugggacucgacugcgagccacgcacuggucuggauuucucugaccuguauuaccucaccaugaauaacaaacauugguuagugcacaaggagugguuucaugauauuccccugccuuggcacgccggggcugacacaggaacuccacacuggaauaacaaagaagcccuuguagaguucaaggacgcgcaugcaaagagacagaccguggucguguugggcucccaggaaggcgccguucacacagcucuggccggggcacuagaggcugaaauggauggagccaaagguaggcucuuuucaggccaucugaagugucggcuuaaaauggacaagcugcgcuugaaaggggugagcuacagucucugcaccgcggccuucacguuuacuaagguccccgcagagacacugcacggaaccgugacuguagagguucaauaugcuggcacagaugguccuuguaaagugccagcccagauggcugucgacaugcagaccuuaacgccgguggggcgacugaucaccgccaaucccgucauuacagaaucuacugagaacuccaagaugaugcucgaacuugauccuccauucggcgacagcuacaucgugauaggaguuggcgauaagaaaauuacccaccauuggcacagaucggggucuacaaucggaaaggcauuugaggccacugugaggggugcuaaacggauggcgguacugggcgacaccgcaugggauuucggguccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8501 - RNA, 1570 nt, Artificial Sequence
  KU963573.2 solE mRNA Design 3 opt
gggagaaagcuuaccaugagccagaaggugaucuaccuggucaugauucuccuuauagcccccgcuuauuccaucagaugcauuggcguuucuaacagggacuucguggaggggaugucaggagguaccuggguagaugugguccuggaacacggcgggugugugacaguuauggcacaagacaaaccuacuguggauaucgaguuggucacgaccacagugaguaauauggccgaaguacggagcuacugcuaugaggcguccauuucugacauggcuucggauucacgcuguccaacucagggagaagccuacuuagacaagcagagcgauacccaguauguuugcaaacgaacacugguggaccguggcugggguaacggguguggacuauuuggcaagggcagucucgugaccugcgcaaaauucacuuguuccaagaagaugacagggaaaucuauccaaccggagaaucuggaguacagaauaaugcuuagcguccauggaucccagcacucagguaugaucggcuaugaaaccgaugagaacagggccaagguggaagucacgcccaauaguccucgggcugaggcaacucugggaggguuuggcagcuugggucucgacugcgagccacgcaccgggcuggauuucucugaccuguacuaccucacaaugaacaauaaacauugguuaguucacaaggaaugguuucaugauauuccccugccuuggcacgccggagcugacacuggcaccccacacuggaacaauaaagaggcccuuguggaguucaaggacgcgcaugcaaagagacagacaguaguggucuugggcucccaggaaggggccgugcacaccgcucuggccggagcacuagaagcugagauggauggugccaaaggcaagcucuuuucagggcaucugaaauguaggcuuaagauggacaaacugcgguugaagggaguuagcuauagucucugcacggcggccuucacuuuuacaaaagugcccgcagagacccugcacggcacugucacaguggaaguacaauacgcugguaccgaugggccuuguaagaucccaguucagauggccguggacaugcagacguuaaccccggucggccgccugauuacagcuaaccccgugaucacugagucuaccgaaaauuccaagaugaugcucgagcuugauccuccauucggagacagcuauauagucauuggcgugggggauaaaaagaucacacaccauuggcaccgaucgggaucuacuauugguaaagccuuugaagcaaccguuagaggcgccaagaggauggcugugcugggggacacagcgugggauuucggauccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8502 - RNA, 1582 nt, Artificial Sequence
  KY075939.1 solE mRNA Design 3 opt
gggagaaagcuuaccaugagccagaaggugaucuaccuggucaugauucuccuuauagcccccgcuuauucccugagaugcaucggcguuucuaacagggacuucguggaggggaugucaggagguaccuggguagauguggucuuggaacacggcgggugugugacaguuauggcacaagacaaaccuacuguggauauugaguuagucacgaccacagugaguaauauggccgaaguacggagcuacugcuaugaggcguccaucucugacauggcuucggauucacgcuguccaacucagggagaagccuaccuggacaagcagagcgauacccaguauguuugcaaacgaacauugguggaccguggcugggguaacggguguggacucuuuggcaagggcagucuggugaccugcgcaaaauucgccuguuccaagaagaugacugggaaaucuauucaaccggagaaucuugaguacagaaucaugcugagcguccauggaucccagcacucagguaugauagugaacgauacaggccaugaaaccgacgagaauagggcuaaggucgaaaucacgcccaacaguccucgggcagaggccacucuagggggauuuggcagccucggucuggauugcgagccacgcaccgggcuggacuucucugaucucuauuacuuaacaaugaauaacaaacacuggcugguucauaaggaaugguuucacgacauuccccuuccuuggcacgcuggagccgacacuggcaccccacauuggaauaacaaagaggcguugguggaguucaaggaugcacacgccaagagacagacaguagugguccugggcucccaggaaggggcugugcauaccgcccuagcaggagcucucgaagccgagauggacggugcgaaaggcaggcugucaagcgggcaccuuaagugucggcugaaaauggauaaguugcgccucaaaggaguuaguuacucucugugcacggccgcauuuacuuucacaaagauccccgcugagaccuuacacggcacugugacagucgaagugcaauaugccgguaccgacgggccuuguaaaguaccagcucagauggccguugauaugcagacgcugaccccggugggccgacucauuacagcaaaucccgucaucacugaguccaccgaaaacagcaagaugaugcuugagcuggacccuccauuuggagauucguacauagugauuggcgucggggaaaagaaaaucacacaucacuggcauagaucuggauccacuauugguaaggccuucgaggcuaccgugaggggcgcgaaacggauggcaguuuugggggacacagccugggauuuuggaucaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8503 - RNA, 1582 nt, Artificial Sequence
  KX447516.1 solE mRNA Design 3 opt
gggagaaagcuuaccaugagcaagaaagugaucuaccuggucaugauucuccuuauagcccccgcuuauuccaucagaugcauuggcguuucuaacagggacuucguggaggggaugucaggagguaccuggguagaugugguccuggaacacggcgggugugugacaguuauggcacaggacaagccuacuguggauaucgaguuggucacgaccacagugaguaauauggccgaaguacggagcuacugcuaugaggcguccauuucugacauggcuucggauucacgcuguccaacucaaggagaagccuacuuagacaaacagagcgauacccaguauguuugcaagcgaacacugguggaccguggcugggguaacggguguggacuauuuggcaaaggcagucucgugaccugcgcaaaguucgccuguuccaagaaaaugacugggaagucuauccagccggagaaucuggaguacagaauaaugcuuagcguccauggaucccaacacucagguaugaucgugaacgauacaggccaugaaaccgacgagaauagggcuaaagucgaaauuacgcccaacaguccucgggcagaggccacucugggaggguuuggcagcuugggucucgauugcgagccacgcaccgggcuggacuucucugaucuguauuaccucacaaugaauaacaagcacugguuaguucauaaagaaugguuucacgacaucccccugccuuggcacgcuggagccgacacuggcaccccacauuggaauaacaaggaggcgcuuguggaguucaaggaugcacacgccaaaagacagacaguaguggucuugggcucccaggaaggggcugugcauaccgcccuggcaggagcucuagaagccgagauggacggugcgaagggcaggcucucaagcgggcaccugaaaugucggcuuaagauggauaaacugcgcuugaagggaguuaguuacucucucugcacggccgcauuuacuuucacaaaaauucccgcugagacccugcacggcacugugacagucgaagugcaguaugccgguaccgacgggccuuguaagguaccagcucaaauggccguugauaugcagacguuaaccccggugggccgacugaucacagcaaaucccgucauaacugaguccaccgaaaacagcaagaugaugcucgagcuugacccuccauuuggagauucguacauugugaucggcgucggggagaaaaagauuacacaucacuggcauagaucuggauccacuaucgguaaagccuucgaagcuaccgugaggggcgcgaagcggauggcaguucugggggacacagccugggauuuuggaucaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8504 - RNA, 1582 nt, Artificial Sequence
  KX447515.1 solE mRNA Design 3 opt
gggagaaagcuuaccaugagccagaaggugaucuaccuggucaugauucuccuuauagcccccgcuuauuccaucagaugcauuggcguuucuaacagggacuucguggaggggaugucaggagguaccuggguagaugugguccuggaacacggcgggugugugacaguuauggcacaagacaaaccuacuguggauaucgaguuggucacgaccacagugaguaauauggccgaaguacggagcuacugcuaugaggcguccauuucugacauggcuucggauucacgcuguccaacucagggagaagccuacuuagacaagcagagcgauacccaguauguuugcaaacgaacacugguggaccguggcugggguaacggguguggacuauuuggcaagggcagucucgugaccugcgcaaaauucgccuguuccaagaagaugacugggaaaucuauccaaccggagaaucuggaguacagaauaaugcuuagcguccauggaucccagcacucagguaugaucgugaacgauacaggccaugaaaccgacgagaauagggcuaaggucgaaauuacgcccaacaguccucgggcagaggccacucugggaggguuuggcagcuugggucucgauugcgagccacgcaccgggcuggacuucucugaucuguauuaccucacaaugaauaacaaacacugguuaguucauaaggaaugguuucacgacaucccccugccuuggcacgcuggagccgacacuggcaccccacauuggaauaacaaagaggcgcuuguggaguucaaggaugcacacgccaagagacagacaguaguggucuugggcucccaggaaggggcugugcauaccgcccuggcaggagcucuagaagccgagauggacggugcgaaaggcaggcucucaagcgggcaccugaagugucggcuuaaaauggauaagcugcgcuugaaaggaguuaguuacucucucugcacggccgcauuuacuuucacaaagauucccgcugagacccugcacggcacugugacagucgaagugcaauaugccgguaccgacgggccuuguaaaguaccagcucagauggccguugauaugcagacguuaaccccggugggccgacugaucacagcaaaucccgucauaacugaguccaccgaaaacagcaagaugaugcucgagcuugacccuccauuuggagauucguacauugugaucggcgucggggaaaagaaaauuacacaucacugguauagaucuggauccacuaucgguaaggccuucgaggcuaccgugaggggcgcgaaacggauggcaguucugggggacacagccugggauuuuggaucaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8505 - RNA, 1582 nt, Artificial Sequence
  KU758874.1 solE mRNA Design 3 opt
gggagaaagcuuaccaugagccagaaggugaucuaccuggucaugauucuccuuauagcccccgcuuauuccaucagaugcauuggcguuucuaacagggacuucguggaggggaugucaggagguaccuggguagaugugguccuggaacacggcgggugugugacaguuauggcacaagacaaaccuacuguggauaucgaguuggucacgaccacagugaguaauauggccgaaguacggagcuacugcuaugaggcguccauuucugacauggcuucggauucacgcuguccaacucagggagaagccuacuuagacaagcagagcgauacccaguauguuugcaaacgaacacugguggaccguggcugggguaacggguguggacuauuuggcaagggcagucucgugaccugcgcaaaauucgccuguuccaagaagaugacugggaaaucuauccaaccggagaaucuggaguacagaauaaugcuuagcguccauggaucccagcacucagguaugaucgugaacgauacaggccaugaaaccgacgagaauagggcuaaggucgaaauuacgcccaacaguccucgggcagaggccacucugggaggguuuggcagcuugggucucgauugcgagccacgcaccgggcuggacuucucugaucuguauuaccucacaaugaauaacaaacacugguuaguucauaaggaaugguuucacgacaucccccugccuuggcacgcuggagccgacacuggcaccccacauuggaauaacaaagaggcgcuuguggaguucaaggaugcacacgccaagagacagacaguaguggucuugggcucccaggaaggggcugugcauaccgcccuggcaggagcucuagaagccgagauggacggugcgaaaggcaagcucucaagcgggcaccugaaauguaggcuuaagauggauaaacugcgguugaagggaguuaguuacucucucugcacggccgcauuuacuuucacaaaaauucccgcugagacccugcacggcacugugacagucgaagugcaauaugccgguaccgacgggccuuguaagguaccagcucagauggccguugauaugcagacguuaaccccggugggccgccugaucacagcaaaucccgucauaacugaguccaccgaaaacagcaagaugaugcucgagcuugacccuccauuuggagauucguacauugugaucggcgucggggagaaaaagauuacacaucacuggcaucgaucuggauccacuaucgguaaagccuucgaagcuaccgugagaggcgcgaagaggauggcaguucugggggacacagccugggauuuuggaucaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8506 - RNA, 1582 nt, Artificial Sequence
  KU729218.1 solE mRNA Design 3 opt
gggagaaagcuuaccaugagccagaaggugaucuaccuggucaugauucuccuuauagcccccgcuuauuccaucagaugcauuggcguuucuaacagggacuucguggaggggaugucaggagguaccuggguagaugugguccuggaacacggcgggugugugacaguuauggcacaagacaaaccuacuguggauaucgaguuggucacgaccacagugaguaauauggccgaaguacggagcuacugcuaugaggcguccauuucugacauggcuucggauucacgcuguccaacucagggagaagccuacuuagacaagcagagcgauacccaguauguuugcaaacgaacacugguggaccguggcugggguaacggguguggacuauuuggcaagggcagucucgugaccugcgcaaaauucgccuguuccaagaagaugacugggaaaucuauccaaccggagaaucuggaguacagaauaaugcuuagcguccauggaucccagcacucagguaugaucgugaacgauacaggccaugaaaccgacgagaauagggcuaaggucgaaauuacgcccaacaguccucgggcagaggccacucugggaggguuuggcagcuugggucucgauugcgagccacgcaccgggcuggacuucucugaucuguauuaccucacaaugaauaacaaacacugguuaguucauaaggaaugguuucacgacaucccccugccuuggcacgcuggagccgacacuggcaccccacauuggaauaacaaagaggcgcuuguggaguucaaggaugcacacgccaagagacagacaguaguggucuugggcucccaggaaggggcugugcauaccgcccuggcaggagcucuagaagccgagauggacggugcgaaaggcaggcucucaagcgggcaccugaagugucggcuuaaaauggauaagcugcgcuugaaaggaguuaguuacucucucugcacggccgcauuuacuuucacaaagauucccgcugagacccugcacggcacugugacagucgaagugcaauaugccgguaccgacgggccuuguaaaguaccagcucagauggccguugauacgcagaccuuaacaccggugggccgacugaucacugcaaaucccgucauaaccgaguccacagaaaacagcaagaugaugcucgagcuugacccuccauuuggagauucguacauugugaucggcgucggggaaaagaaaauuacucaucacuggcauagaucuggauccaccaucgguaaggccuucgaggcuacagugaggggcgcgaaacggauggcaguucugggggacaccgccugggauuuuggaucaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8507 - RNA, 1582 nt, Artificial Sequence
  KU501217.1 solE mRNA Design 3 opt
gggagaaagcuuaccaugagccagaaggugaucuaccuggucaugauucuccuuauagcccccgcuuauuccaucagaugcauuggcguuucuaacagggacuucguggaggggaugucaggagguaccuggguagaugugguccuggaacacggcgggugugugacaguuauggcacaagacaaaccuacuguggauaucgaguuggucacgaccacagugaguaauauggccgaaauucggagcuacugcuaugaggcguccaucucugacauggcuucggauucacgcuguccaacucagggagaagccuacuuagacaagcagagcgauacccaguauguaugcaaacgaacacugguugaccguggcugggguaacggguguggacuauuuggcaagggcagucucgugaccugcgcaaaauucgccuguuccaagaagaugacugggaaaucuauacaaccggagaaucuggaguacagaaucaugcuuagcguccauggaucccagcacucagguaugauugugaacgauacaggccaugaaaccgacgagaauagggcuaagguggaaaucacgcccaacaguccucgggcagaggccacucugggaggguuuggcagcuugggucucgauugcgagccacgcaccgggcuggacuucucugaucuguauuaccucacaaugaauaacaaacacugguuaguccauaaggaaugguuucacgacauuccccugccuuggcacgcuggagccgacacuggcaccccacauuggaauaacaaagaggcgcuuguugaguucaaggaugcacacgccaagagacagacagugguaguguugggcucccaggaaggggcuguccauaccgcccuggcaggagcucuagaagccgagauggacggugcgaaaggcaggcucucaagcgggcaccugaagugucggcuuaaaauggauaagcugcgcuugaaaggagugaguuacucucucugcacggccgcauuuacuuucacaaagauccccgcugagacccugcacggcacuguuacaguggaaguccaauaugccgguaccgacgggccuuguaaagugccagcucagauggccguagauaugcagacguuaaccccgguuggccgacugauaacagcaaaucccgugauuacugaguccaccgaaaacagcaagaugaugcucgagcuugacccuccauuuggagauucguacaucgucauuggcgugggggaaaagaaaaucacacaucacuggcauagaucuggauccacuaucgguaaggccuucgaggcuaccgucaggggcgcgaaacggauggcagugcugggggacacagccugggauuuuggaucaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8508 - RNA, 1582 nt, Artificial Sequence
  KU761561.1 solE mRNA Design 3 opt
gggagaaagcuuaccaugagccagaaggugaucuaccuggucaugauucuccuuauagcccccgcuuauuccaucagaugcauuggcguuucuaacagggacuucguggaggggaugucaggagguaccuggguagaugugguccuggaacacggcgggugugugacaguuauggcacaagacaaaccuacuguggauaucgaguuggucacgaccacagugaguaauauggccgaaguacggagcuacugcuaugaggcguccauuucugacauggcuucggauucacgcuguccaacucagggagaagccuacuuagacaagcagagcgauacccaguauguuugcaaacgaacacugguggaccguggcugggguaacggguguggacuauuuggcaagggcagucucgugaccugcgcaaaauucgccuguuccaagaagaugacugggaaaucuauccaaccggagaaucuggaguacagaauaaugcuuagcguccauggaucccagcacucagguaugaucgugaacgauacaggccaugaaaccgacgagaauagggcuaaggucgaaauuacgcccaacaguccucgggcagaggccacucugggaggguuuggcagcuugggucucgauugcgagccacgcaccgggcuggacuucucugaucuguauuaccucacaaugaauaacaaacacugguuaguucauaaggaaugguuucacgacaucccccugccuuggcacgcuggagccgacacuggcaccccacauuggaauaacaaagaggcgcuuguggaguucaaggaugcacacgccaagagacagacaguaguggucuugggcucccaggaaggggcugugcauaccgcccuggcaggagcucuagaagccgagauggacggugcgaaaggcaggcucucaagcgggcaccugaagugucggcuuaaaauggauaagcugcgcuugaaaggaguuaguuacucucucugcacggccgcauuuacuuucacaaagauucccgcugagacccugcacggcacugugacagucgaagugcaauaugccgguaccgacgggccuuguaaaguaccagcucagauggccguugauaugcagacguuaaccccggugggccgacugaucacagcaaaucccgucauaacugaguccaccgaaaacagcaagaugaugcucgagcuugacccuccauuuggagauucguacauugugaucggcgucggggaaaagaaaauuacacaucacuggcauagaucuggauccacuaucgguaaggccuucgaggcuaccgugaggggcgcgcggcguauggcaguucugggggacacagccugggauuuuggaucaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8509 - RNA, 1582 nt, Artificial Sequence
  KY075937.1 solE mRNA Design 3 opt
gggagaaagcuuaccaugagccagaaggugaucuaccuggucaugauucuccuuauagcccccgcuuauuccaucagaugcauuggcguuucuaacagggacuucguggaggggaugucaggagguaccuggguagaugugguccuggaacacggcgggugugugacaguuauggcacaagacaaaccuacuguggauaucgaguuggucacgaccacagugaguaauauggccgaaguacggagcuacugcuaugaggcguccauuucugacaugguuucggauucacgcuguccaacucagggagaggcuuacuuagacaagcagagcgauacccaguaugugugcaaacgaacacuggucgaccguggcugggguaacggguguggacuauuuggcaagggcagucucgugaccugcgccaaauucgcauguuccaagaagaugacugggaaaucuauccaaccggaaaaucuggaguacagaauaaugcuuagcgugcauggaucccagcacucagguaugaucgucaacgauacaggccaugaaaccgacgagaauagggccaagguugaaauuacgcccaacaguccucgggcugaggcaacucugggaggguuuggcagcuugggucucgauugcgagccacgcaccgggcuggacuucucugaucuguauuaccucacaaugaauaacaaacacugguuagugcauaaggaaugguuucacgacaucccccugccuuggcacgccggagcugacacuggcaccccacauuggaauaacaaagaggcccuuguagaguucaaggaugcgcacgcaaagagacagacaguggucguguugggcucccaggaaggggccguucauaccgcucuggccggagcacuagaagcugagauggacggugccaaaggcaggcucucaagcgggcaccugaagugucggcuuaaaauggauaagcugcgcuugaaaggagugaguuacucucucugcacggcggccuuuacuuucacaaagauucccgcagagacccugcacggcacugucacaguggaaguacaauaugcugguaccgacgggccuuguaaaguuccagcccagauggcuguggauaugcagacguuaaccccggucggccgacugaucacagccaaucccgugauaacugaguccaccgaaaacagcaagaugaugcucgagcuugacccuccauuuggagauucguacauugucaucggcgugggggaaaagaaaauuacacaucacuggcauagaucuggauccacuaucgguaaggcauucgaggccaccguuaggggcgcuaaacggauggcggugcugggggacacagcaugggauuuuggaucaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8510 - RNA, 1582 nt, Artificial Sequence
  KY014317.1 solE mRNA Design 3 opt
gggagaaagcuuaccaugagccagaaggugaucuaccuggucaugauucuccuuauagcccccgcuuauuccaucagaugcauuggcguuucuaacagggacuucguggaggggaugucaggagguaccuggguagaugugguccuggaacacggcgggugugugacaguuauggcacaagacaaaccuacuguggauaucgaguuggucacgaccacagugaguaauauggccgaaguacggagcuacugcuaugaggcguccauuucugacauggcuucggauucacgcuguccaacucagggagaagccuacuuagacaagcagagcgauacccaguauguuugcaaacgaacacugguggaccguggcugggguaacggguguggacuauuuggcaagggcagucucgugaccugcgcaaaauucgccuguuccaagaagaugacugggaaaucuauccaaccggagaaucuggaguacagaauaaugcuuagcguccauggaucccagcacucagguaugaucgugaacgauacaggccaugaaaccgacgagaauagggcuaaggucgaaauuacgcccaacaguccucgggcagaggccacucugggaggguuuggcagcuugggucucgauugcgagccacgcaccgggcuggacuucucugaucuguauuaccucacaaugaauaacaaacacugguuaguucauaaggaaugguuucacgacaucccccugccuuggcacgcuggagccgacacuggcaccccacauuggaauaacaaagaggcgcuuguggaguucaaggaugcacacgccaagagacagacaguaguggucuugggcucccaggaaggggcugugcauaccgcccuggcaggagcucuagaagccgagauggacggugcgaaaggcaggcucucaagcgggcaccugaagugucggcuuaaaauggauaagcugcgcuugaaaggaguuaguuacucucucugcacggccgcauuuacuuucacaaagauucccgcugagacccugcacggcacugugacagucgaagugcaauaugccgguaccgacgggccuuguaaaguaccagcucagauggccguugauaugcagacguuaaccccggugggccgacugaucacagcaaaucccgucauaacugaguccauugaaaacagcaagaugaugcucgagcuugacccuccauuuggagauucguacaucgugauuggcgucggggaaaagaaaaucacccaucacuggcauagaucuggauccacaaucgguaaggccuucgaggcuacugugaggggcgcgaaacggauggcaguucugggggacaccgccugggauuuuggaucaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8511 - RNA, 1582 nt, Artificial Sequence
  KU870645.1 solE mRNA Design 3 opt
gggagaaagcuuaccaugagccagaaggugaucuaccuggucaugauucuccuuauagcccccgcuuauuccaucagaugcauuggcguuucuaacagggacuucguggaggggaugucaggagguaccuggguagaugugguccuggaacacggcgggugugugacaguuauggcacaagacaaaccuacuguggauaucgaguuggucacgaccacagugaguaauauggccgaaguacggagcuacugcuaugaggcguccauuucugacauggcuucggauucacgcuguccaacucagggagaagccuacuuagacaagcagagcgauacccaguauguuugcaaacgaacacugguggaccguggcugggguaacggguguggacuauuuggcaagggcagucucgugaccugcgcaaaauucgccuguuccaagaagaugacugggaaaucuauccaaccggagaaucuggaguacagaauaaugcuuagcguccauggaucccagcacucagguaugaucgugaacgauacaggccaugaaaccgacgagaauagggcuaaggucgaaauuacgcccaacaguccucgggcagaggccacucugggaggguuuggcagcuugggucucgauugcgagccacgcaccgggcuggacuucucugaucuguauuaccucacaaugaauaacaaacacugguuaguucauaaggaaugguuucacgacaucccccugccuuggcacgcuggagccgacacuggcaccccacauuggaauaacaaagaggcgcuuguggaguucaaggaugcacacgccaagagacagacaguaguggucuugggcucccaggaaggggcugugcauaccgcccuggcaggagcucuagaagccgagauggacggugcgaaaggcaggcucucaagcgggcaccugaagugucggcuuaaaauggauaagcugcgcuugaaaggaguuaguuacucucucugcacggccgcauuuacuuucacaaagauucccgcugagacccugcacggcacugugacagucgaagugcaauaugccgguaccgacgggccuuguaaaguaccagcucagauggccguugauaugcagacguuaaccccggugggccgacugaucacagcaaaucccgucauaacugaguccaccgaaaacagcaagaugaugcucgagcuugacccuccauuuggagauucguacauugugaucggcauuggggaaaagaaaaucacacaucacuggcauagaucuggauccacuaucgguaaggccuucgaggcuaccgucaggggcgcgaaacggauggcagugcugggggacacagccugggauuuuggaucaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8512 - RNA, 1582 nt, Artificial Sequence
  KU922923.1 solE mRNA Design 3 opt
gggagaaagcuuaccaugagccagaaggugaucuaccuggucaugauucuccuuauagcccuggcuuauuccaucagaugcauuggcguuucuaacagggacuucguggaggggaugucaggagguaccuggguagauguggucuuggaacacggcgggugugugacaguuauggcacaagacaaacccacuguggauaucgaguuagucacgaccacagugaguaauauggccgaaguacggagcuacugcuaugaggcguccauuucugacauggcuucggauucacgcuguccuacucagggagaagccuaccuggacaagcagagcgauacccaguauguuugcaaacgaacauugguggaccguggcugggguaacggguguggacucuuuggcaagggcagucuggugaccugcgcaaaauucgccuguuccaagaagaugacugggaaaucuauccaaccagagaaucuugaguacagaauaaugcugagcguccauggaucccagcacucagguaugaucgugaacgauacaggccaugaaaccgacgagaauagggcuaaggucgaaauuacgccgaacaguccccgggcagaggccacucuagggggauuuggcagccucggucuggauugcgagccucgcaccgggcuggacuucucugaucucuauuacuuaacaaugaauaacaaacacuggcugguucauaaggaaugguuucacgacaucccacuucccuggcacgcuggagccgacacuggcaccccucauuggaauaacaaagaggcguugguggaguucaaggaugcacacgccaagagacagacaguagugguccugggcucccaggaaggggcugugcauaccgcccuagcaggagcucucgaagccgagauggacggugcgaaaggcaggcugucaagcgggcaccuuaagugucggcugaaaauggauaaguugcgccucaaaggaguuaguuacucucugugcacggccgcauuuacuuucacaaagauuccagcugagaccuuacacggcacugugacagucgaagugcaauaugccgguaccgacgggcccuguaaaguaccugcucagauggccguugauaugcagacgcugaccccagugggccgacucaucacagcaaauccggucauaacugaguccaccgaaaacagcaagaugaugcuugagcuggaucccccuuuuggagacucguacauugugaucggcgucggggaaaagaaaauuacacaucacuggcauagaucuggauccacuaucgguaaggccuucgaggcuaccgugaggggcgcgaaacggauggcaguuuugggggacacagccugggauuuuggaucaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8513 - RNA, 1582 nt, Artificial Sequence
  KU497555.1 solE mRNA Design 3 opt
gggagaaagcuuaccaugagccagaaggugaucuaccuggucaugauucuccuuauagcccccgcuuauuccaucagaugcauuggcguuucuaacagggacuucguggaggggaugucaggagguaccuggguagaugugguccuggaacacggcgggugugugacaguuauggcacaagacaaaccuacuguggauaucgaguuggucacgaccacagugaguaauauggccgaaguacggagcuacugcuaugaggcguccauuucugacauggcuucggauucacgcuguccaacucagggagaagccuacuuagacaagcagagcgauacccaguauguuugcaaacgaacacugguggaccguggcugggguaacggguguggacuauuuggcaagggcagucucgugaccugcgcaaaauucgccuguuccaagaagaugacugggaaaucuauccaaccggagaaucuggaguacagaauaaugcuuagcguccauggaucccagcacucagguaugaucgugaacgauacaggccaugaaaccgacgagaauagggcuaaggucgaaauuacgcccaacaguccucgggcagaggccacucugggaggguuuggcagcuugggucucgauugcgagccacgcaccgggcuggacuucucugaucuguauuaccucacaaugaauaacaaacacugguuaguucauaaggaaugguuucacgacaucccccugccuuggcacgcuggagccgacacuggcaccccacauuggaauaacaaagaggcgcuuguggaguucaaggaugcacacgccaagagacagacaguaguggucuugggcacccaggaaggggcugugcauacggcccuggcaggagcucuagaagccgagauggacggugcgaaaggcaggcucuccucagggcaccugaagugucggcuuaaaauggauaagcugcgcuugaaaggaguuagcuacagucucugcacugccgcauuuacauucaccaagauucccgcugagacucugcacggcacagugaccgucgaagugcaauaugccgguacggacgggccuuguaaaguaccagcucagauggccguugauaugcagaccuuaacaccggugggccgacugaucacugcaaaucccgucauaaccgagucuacagaaaacuccaagaugaugcucgagcuugacccuccauuuggagauagcuacauugugaucggcgucggggaaaagaaaauuacucaucacuggcauagaucgggaucuaccaucgguaaggccuucgaggcuacagugaggggcgcgaaacggauggcaguucugggggacaccgccugggauuuuggauccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8514 - RNA, 1582 nt, Artificial Sequence
  KU312314.1 solE mRNA Design 3 opt
gggagaaagcuuaccaugagccagaaggugaucuaccuggucaugauucuccuuauagcccccgcuuauuccaucagaugcauuggcguuucuaacagggacuucguggaggggaugucaggagguaccuggguagaugugguccuggaacacggcgggugugugacaguuauggcacaagacaaaccuacuguggauaucgaguuggucacgaccacagugaguaauauggccgaaguacggagcuacugcuaugaggcguccauuucugacauggcuucggauucacgcuguccaacucagggagaagccuacuuagacaagcagagcgauacccaguauguuugcaaacgaacacugguggaccguggcugggguaacggguguggacuauuuggcaagggcagucucgugaccugcgcaaaauucgccuguuccaagaagaugacugggaaaucuauccaaccggagaaucuggaguacagaauaaugcuuagcguccauggaucccagcacucagguaugaucgugaacgauacaggccaugaaaccgacgagaauagggcuaaggucgaaauuacgcccaacaguccucgggcagaggccacucugggaggguuuggcagcuugggucucgauugcgagccacgcaccgggcuggacuucucugaucuguauuaccucacaaugaauaacaaacacugguuaguucauaaggaaugguuucacgacaucccccugccuuggcacgcuggagccgacacuggcaccccacauuggaauaacaaagaggcgcuuguggaguucaaggaugcacacgccaagagacagacaguaguggucuugggcucccaggaaggggcugugcauaccgcccuggcaggagcucuagaagccgagauggacggugcgaaaggcaggcucucaagcgggcaccugaagugucggcuuaaaauggauaagcugcgcuugaaaggaguuaguuacucucucugcacggccgcauuuacuuucacaaagauucccgcugagacccugcacggcacugugacagucgaagugcaauaugccgguaccgacgggccuuguaaaguauuagcucagauggccguugauaugcagacgcugaccccagugggccgacucaucacagcaaauccggucauaacugaguccaccgaaaacagcaagaugaugcuugagcuggaucccccuuuuggagacucguacauugugaucggcgucggggaaaagaaaauuacacaucacuggcauagaucuggauccacuaucgguaaggccuucgaggcuaccgugaggggcgcgaaacggauggcaguuuugggggacacagccugggauuuuggaucaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8515 - RNA, 1582 nt, Artificial Sequence
  KY014314.1 solE mRNA Design 3 opt
gggagaaagcuuaccaugagccagaaggugaucuaccuggucaugauucuccuuauagcccccgcuuauuccaucagaugcauuggcguuucuaacagggacuucguggaggggaugucaggagguaccuggguagaugugguccuggaacacggcgggugugugacaguuauggcacaagacaaaccuacuguggauaucgaguuggucacgaccacagugaguaauauggccgaaguacggagcuacugcuaugaggcguccauuucugacauggcuucggauucacgcuguccaacucagggagaagccuacuuagacaagcagagcgauacccaguauguuugcaaacgaacacugguggaccguggcugggguaacggguguggacuauuuggcaagggcagucucgugaccugcgcaaaauucgccuguuccaagaagaugacugggaaaucuauccaaccggagaaucuggaguacagaauaaugcuuagcguccauggaucccagcacucagguaugaucgugaacgauacaggccaugaaaccgacgagaauagggcuaaggucgaaauuacgcccaacaguccucgggcagaggccacucugggaggguuuggcagcuugggucucgauugcgagccacgcaccgggcuggacuucucugaucuguauuaccucacaaugaauaacaaacacugguuaguucauaaggaaugguuucacgacaucccccugccuuggcacgcuggagccgacacuggcaccccacauuggaauaacaaagaggcgcuuguggaguucaaggaagcacacgccaagagacagacaguaguggucuugggcucccaggaaggggcugugcauaccgcccuggcaggagcucuagaggccgagauggauggugcgaaaggcaggcucucaagcgggcaccugaagugucggcuuaaaauggacaagcugcgcuugaaaggaguuaguuacucucucugcacggccgcauuuacuuucacaaagauucccgcugaaacccugcacggcacugugacagucgaggugcaauaugccgguaccgaugggccuuguaaaguaccagcucagauggccguugacaugcagacguuaaccccggugggccgacugaucacagcaaaucccgucauaacugaauccaccgagaacagcaagaugaugcucgaacuugauccuccauuuggagacucguacauugugaucggcgucggggagaagaaaauuacacaucacuggcauagaucuggauccacuaucgguaaggccuucgaggcuaccgugaggggcgcgaaacggauggcaguucugggggauacagccugggacuuuggaucaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8516 - RNA, 1582 nt, Artificial Sequence
  KX447517.1 solE mRNA Design 3 opt
gggagaaagcuuaccaugagccagaaggugaucuaccuggucaugauucuccuuauagcccccgcuuauuccaucagaugcauuggcguuucuaacagggacuucguggaggggaugucaggagguaccuggguagaugugguccuggaacacggcgggugugugacaguuauggcacaagacaaaccuacuguggauaucgaguuggucacgaccacagugaguaauauggccgaaguacggagcuacugcuaugaggcguccauuucugacauggcuucggauucacgcuguccaacucagggagaagccuacuuagacaagcagagcgauacccaguauguuugcaaacgaacacugguggaccguggcugggguaacggguguggacuauuuggcaagggcagucucgugaccugcgcaaaauucgccuguuccaagaagaugacugggaaaucuauccaaccggagaaucuggaguacagaauaaugcuuagcguccauggaucccagcacucagguaugaucgugaacgauacaggccaugaaaccgacgagaauagggcuaaggucgaaauuacgcccaacaguccucgggcagaggccgcucugggaggguuuggcagcuugggucucgauugcgagccacgcacugggcuggacuucucugaucuguauuaccucaccaugaauaacaaacacugguuaguucauaaggaaugguuucacgacaucccccugccuuggcacgccggagcggacacaggcacuccacauuggaauaacaaagaggcacuuguggaguucaaggaugcccacgcuaagagacagaccguaguggucuugggcucccaggaaggggccgugcauacagcacuggcuggagcccuagaagcggagauggacggugccaaaggcaggcucucaagcgggcaccugaagugucggcuuaaaauggauaagcugcgcuugaaaggaguuaguuacucucucugcaccgcagcuuuuacguucacuaagauucccgccgagacacugcacggcaccgugacugucgaagugcaauaugcugguacagacgggccuuguaaaguaccagcccagauggcaguugauaugcagaccuuaacgccggugggccgacugaucaccgccaaucccgucauaacagaguccacugaaaacagcaagaugaugcucgagcuugacccuccauuuggagauucguacauugugaucggcgucggggaaaagaaaauuacccaucacuggcauagaucuggauccacaaucgguaaggcuuucgaggcgacugugaggggcgcaaaacggauggccguucugggggacaccgcuugggauuuuggaucaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8517 - RNA, 1582 nt, Artificial Sequence
  KU729217.2 solE mRNA Design 3 opt
gggagaaagcuuaccaugagccagaaggugaucuaccuggucaugauucuccuuauagcccccgcuuauuccaucagaugcauuggcguuucuaacagggacuucguggaggggaugucaggagguaccuggguagaugugguccuggaacacggcgggugugugacaguuauggcacaagacaaaccuacuguggauaucgaguuggucaguacgaccgugagcaauauggccgaaguacgguccuacugcuaugaggcgacaauuucugacaucgcuucggauucacgcuguccaacucagggagaagccuacuuagacaagcagagcgauacccaguauguuugcaaacgaacacugguggaccguggcugggguaacggguguggacuauuuggcaagggcagucucgugaccugcgcaaaauucgccuguuccaagaagaugacugggaaaucuauacaaccggagaaucuggaguacagaaucaugcuuagcguccauggaucccagcacucagguaugauugugaacgauacaggccaugaaaccgacgagaauagggcuaaggucgaaaucacgcccaacaguccucgggcagaggccacucugggaggguuuggcagcuugggucucgauugcgagccacgcaccgggcuggacuucucugaucuguauuaccucacaaugaauaacaaacacugguuaguucauaaggaaugguuucacgacauuccccugccuuggcacgcuggagccgacacuggcaccccacauuggaauaacaaagaggcgcuuguggaguucaaggaugcacacgccaagagacagacagcuguaguguugggcucccaggaaggggccguccauaccgcacuggcuggagcccuagaagcggagauggacggugccaaaggcaggcucucaagcgggcaccugaagugucggcuuaaaauggauaagcugcgcuugaaaggagugaguuacucucucugcacggcagcuuuuacuuucacaaagauccccgccgagacccugcacggcacuguuacaguggaaguccaauaugcugguaccgacgggccuuguaaagugccagcccagauggcaguagauaugcagacguuaaccccgguuggccgacugauaacagccaaucccgugauuacugaguccaccgaaaacagcaagaugaugcucgagcuugacccuccauuuggagauucguacaucgucauuggcgugggggaaaagaaaaucacacaucacuggcauagaucuggauccacuaucgguaaggcuuucgaggcgaccgucaggggcgcaaaacggauggccgugcugggggacacagcuugggauuuuggaucaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8518 - RNA, 1582 nt, Artificial Sequence
  KY328290.1 solE mRNA Design 3 opt
gggagaaagcuuaccaugagccagaaggugaucuaccuggucaugauucuccuuauagcccccgcuuauuccaucagaugcauuggcguuucuaacagggacuucguggaggggaugucaggagguaccuggguagaugugguccuggaacacggcgggugugugacaguuauggcacaagacaaaccuacuguggauaucgaguuggucacgaccacagugaguaauauggccgaaguacggagcuacugcuaugaggcguccauuucugacauggcuucggauucacgcuguccaacucagggagaagccuacuuagacaagcagagcgauacccaguauguuugcaaacgaacacugguggaccguggcugggguaacggguguggacuauuuggcaagggcagucucgugaccugcgcaaaauucgccuguuccaagaagaugacugggaaaucuauccaaccggagaaucuggaguacagaauaaugcuuagcguccauggaucccagcacucagguaugaucgugaacgauacaggccaugaaaccgacgagaauagggcuaaggucgaaauuacgcccaacaguccucgggcagaggccacucugggaggguuuggcagcuugggucucgauugcgagccacgcaccgggcuggacuucucugaucuguauuaccucacaaugaauaacaaacacugguuaguucauaaggaaugguuucacgacaucccccugccuuggcacgcuggagccgacacuggcaccccacauuggaauaacaaagaggcgcuuguggaguucaaggaugcacacgccaagagacagacaguaguggucuugggcucccaggaaggggcugugcauaccgcccuggcaggagcucuagaagccgagauggacggugcgaaaggcaggcucucaagcgggcaccugaagugucggcuuaaaauggauaagcugcgcuugaaaggaguuaguuacucucucugcacggccgcauuuacuuucuccaagauucccgcugagacacugcacggcaccgugacugaagagguccaauaugccgguacagacgggccuuguaaagugccagcucagauggccguagauaugcagaccuuaacgccgguuggccgacugaucaccgcaaaucccgugauaacagaaagcacugagaacucgaagaugaugcucgaacuugacccuccauuuggagauucuuacauugucaucggcgugggggagaagaaaauuacccaucacuggcauagauccggaucaacaaucgguaaggccuucgaggcuacugucaggggcgcgaaacggauggcagugcugggggacaccgccugggauuuuggaaguugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8519 - RNA, 1582 nt, Artificial Sequence
  KX087101.3 solE mRNA Design 3 opt
gggagaaagcuuaccaugagccagaaggugaucuaccuggucaugauucuccuuauagcccccgcuuauuccaucagaugcauuggcguuucuaacagggacuucguggaggggaugucaggagguaccuggguagaugugguccuggaacacggcgggugugugacaguuauggcacaagacaaaccuacuguggauaucgaguuggucacgaccacagugaguaauauggccgaaguacggagcuacugcuaugaggcguccauuucugacauggcuucggauucacgcuguccaacucagggagaagccuacuuagacaagcagagcgauacccaguauguuugcaaacgaacacugguggaccguggcugggguaacggguguggacuauuuggcaagggcagucucgugaccugcgcaaaauucgccuguuccaagaagaugacugggaaaucuauccaaccggagaaucuggaguacagaauaaugcuuagcguccauggaucccagcacucagguaugaucgugaacgauacaggccaugaaaccgacgagaauagggcuaaggucgaaauuacgcccaacaguccucgggcagaggccacucugggaggguuuggcagcuugggucucgauugcgagccacgcaccgggcuggacuucucugaucuguauuaccucacaaugaauaacaaacacugguuaguucauaaggaaugguuucacgacaucccccugccuuggcacgcuggagccgacacuggcaccccacauuggaauaacaaagaggcgcuuguggaguucaaggaugcacacgccaagagacagacaguaguggucuugggcucccaggaaggggcugugcauaccgcccuggcaggagcucuagaagccgagauggacggugcgaaaggcaggcucucaagcgggcaccugaagugucggcuuaaaauggauaagcugcgcuugaaaggaguuaguuacucucucugcacggccgcauuuacuuucacaaagauucccgcugagacccugcacggcacugugacagucgaauuacaauaugccgguaccgacgggccuuguaaagugccagcucagauggccguagauaugcagacgcugaccccgguuggccgacucaucacagcaaaucccgugauaacugaguccaccgaaaacagcaagaugaugcuugagcuggacccuccauuuggagauucguacauugucaucggcgugggggaaaagaaaauuacacaucacuggcauagaucuggauccacuaucgguaaggccuucgaggcuaccgucaggggcgcgaaacggauggcaguguugggggacacagccugggauuuuggaucaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8520 - RNA, 1582 nt, Artificial Sequence
  KY003156.1 solE mRNA Design 3 opt
gggagaaagcuuaccaugagccagaaggugaucuaccuggucaugauucuccuuauagcccccgcuuauuccaucagaugcauuggcaucucuaacagggacuucguugaggggaugucaggagguaccuggguggauguagugcuggaacacggcgggugugucacagugauggcacaagacaaaccuacuguugauauugaguuggugacgaccacagucaguaauauggccgaagugcggagcuacugcuaugaggcguccaucucugacauggcuucggauucacgcuguccaacucagggagaagccuacuuagacaagcagagcgauacccaguauguaugcaaacgaacacugguugaccguggcugggguaacggguguggacuauuuggcaagggcagucucgugaccugcgcaaaauucgccuguuccaagaagaugacugggaaaucuauacaaccggagaaucuggaguacagaaucaugcuuagcguccauggaucccagcacucagguaugauugugaacgauacaggccaugaaaccgacgagaauagggcuaagguggaaaucacgcccaacaguccucgggcagaggccacucugggaggguuuggcauuuugggucucgauugcgagccacgcaccgggcuggacuucagcgaucuguauuaccucacaaugaauaacaaacacugguuaguccauaaggaaugguuucacgacaucccccugccuuggcacgcuggagccgacacuggcaccccacauuggaauaacaaagaggcgcuuguugaguucaaggaugcacacgccaagagacagacagugguaguguugggcucucaggaaggggcuguccauaccgcccuggcaggagcucuagaagccgagauggacggugcgaaaggcaggcucuccucagggcaccugaagugucggcuuaaaauggauaagcugcgcuugaaaggagugagcuacagucucugcacggccgcauuuacuuucacaaagauacccgcugagacccugcacggcacuguuacaguggaaguccaauaugccgguaccgacgggccuuguaaagugccagcucagauggccguagauaugcagacguuaaccccgguuggccgacugauuacagcaaaucccgugaucacugagucuaccgaaaacuccaagaugaugcucgagcuugacccuccauuuggagauagcuacauugucaucggcgugggggaaaagaaaaucacacaucacuggcauagaucgggaucuacuauugguaaggccuucgaggcuaccgucaggggcgcgaaacggauggcagugcugggggacacagccugggauuuuggauccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8521 - RNA, 1582 nt, Artificial Sequence
  KU758876.1 solE mRNA Design 3 opt
gggagaaagcuuaccaugagccagaaggugaucuaccuggucaugauucuccuuauagcccccgcuuauuccaucagaugcauuggcguuucuaacagggacuucguggaggggaugucaggagguaccuggguagaugugguccuggaacacggcgggugugugacaguuauggcacaagacaaaccuacuguggauaucgaguuggucacgaccacagugaguaauauggccgaaguacggagcuacugcuaugaggcguccauuucugacauggcuucggauucacgcuguccaacucagggagaagccuacuuagacaagcagagcgauacccaguauguuugcaaacgaacacugguggaccguggcugggguaacggguguggacuauuuggcaagggcagucucgugaccugcgcaaaauucgccuguuccaagaagaugacugggaaaucuauccaaccggagaaucuggaguacagaauaaugcuuagcguccauggaucccagcacucagguaugaucgugaacgauacaggccaugaaaccgacgagaauagggcuaaggucgaaauuacgcccaacaguccucgggcagaggccacucugggaggguuuggcagcuugggucucgauugcgagccacgcaccgggcuggacuucucugaucuguauuaccucacaaugaauaacaaacacugguuaguucauaaggaaugguuucacgacaucccccugccuuggcacgcuggagccgacacuggcaccccacauuggaauaacaaagaggcgcuuguggaguucaaggaugcacacgccaagagacagacaguaguggucuugggcucccaggaaggggcugugcauaccgcccuggcaggagcucuagaagccgagauggacgguguuaaaggcaggcucucaagcgggcaccugaagugucggcuuaaaauggauaagcugcgcuugaaaggagugaguuacucucucugcacggcggccuuuacuuucacaaagauucccgcagagacccugcacggcacugucacaguggaaguacaauaugcugguaccgacgggccuuguaaaguuccagcccagauggcuguggauaugcagacguuaaccccggucggccgacugaucacagccaaucccgugauaacugaguccaccgaaaacagcaagaugaugcucgagcuugacccuccauuuggagauucguacauugucaucggcgugggggaaaagaaaauuacacaucacuggcauagaucuggauccacuaucgguaaggcauucgaggccaccguuaggggcgcuaaacggauggcggugcugggggacacagcaugggauuuuggaucaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8522 - RNA, 1582 nt, Artificial Sequence
  KU926310.1 solE mRNA Design 3 opt
gggagaaagcuuaccaugagccagaaggugaucuaccuggucaugauucuccuuauagcccccgcuuauuccaucagaugcauuggcguuucuaacagggacuucguggaggggaugucaggagguaccuggguagaugugguccuggaacacggcgggugugugacaguuauggcacaagacaaaccuacuguggauaucgaguuggucacgaccacagugaguaauauggccgaaguacggagcuacugcuaugaggcguccauuucugacauggcuucggauucacgcuguccaacucagggagaagccuacuuagacaagcagagcgauacccaguauguuugcaaacgaacacugguggaccguggcugggguaacggguguggacuauuuggcaagggcagucucgugaccugcgcaaaauucgccuguuccaagaagaugacugggaaaucuauccaaccggagaaucuggaguacagaauaaugcuuagcguccauggaucccagcacucagguaugaucgugaacgauacaggccaugaaaccgacgagaauagggcuaaggucgaaauuacgcccaacaguccucgggcagaggccacucugggaggguuuggcagcuugggucucgauugcgagccacgcaccgggcuggacuucucugaucuguauuaccucacaaugaauaacaaacacugguuaguucauaaggaaugguuucacgacaucccccugccuuggcacgcuggagccgacacuggcaccccacauuggaauaacaaagaggcgcuuguggaguucaaggaugcacacgccaagagacagacaguaguggucuugggcucccaggaaggggcugugcauaccgcccuggcaggagcucuagaagccgagauggacggugcgaaaggcaggcucucaagcgggcaccugaagugucggcuuaaaauggauaagcugcgcuugaaaggaguuaguuacucucucugcacggccgcauuuacuuucacaaagauucccgcugagacccugcacggcacugugacagucgaagugcaauaugccggugcugacgggccuuguaaaguaccagcccagauggcaguugauaugcagaccuuaacgccggugggccgacugaucaccgccaaucccgucauaacagaguccacugaaaacagcaagaugaugcucgagcuugacccuccauuuggagauucguacauugugaucggcgucggggaaaagaaaauuacccaucacuggcauagaucuggauccacaaucgguaaggcuuucgaggcgacugugaggggcgcaaaacggauggccguucugggggacaccgcuugggauuuuggaucaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8523 - RNA, 1582 nt, Artificial Sequence
  KU681081.3 solE mRNA Design 3 opt
gggagaaagcuuaccaugagccagaaggugaucuaccuggucaugauucuccuuauagcccccgcuuauuccaucagaugcauuggcguuucuaacagggacuucguggaggggaugucaggagguaccuggguagaugugguccuggaacacggcgggugugugacaguuauggcacaagacaaaccuacuguggauaucgaguuggucacgaccacagugaguaauauggccgaaguacggagcuacugcuaugaggcguccauuucugacauggcuucggauucacgcuguccaacucagggagaagccuacuuagacaagcagagcgauacccaguauguuugcaaacgaacacugguggaccguggcugggguaacggguguggacuauuuggcaagggcagucucgugaccugcgcaaaauucgccuguuccaagaagaugacugggaaaucuauccaaccggagaaucuggaguacagaauaaugcuuagcguccauggaucccagcacucagguaugaucgugaacgauacaggccaugaaaccgacgagaauagggcuaaggucgaaauuacgcccaacaguccucgggcagaggccacucugggaggguuuggcagcuugggucucgauugcgagccacgcaccgggcuggacuucucugaucuguauuaccucacaaugaauaacaaacacugguuaguucauaaggaaugguuucacgacaucccccugccuuggcacacuggagcugacaccggcacaccacauuggaauaacaaagaggcccuuguggaguucaaggaugcgcacgcaaagagacagaccguaguggucuugggcucccaggaaggggccgugcauacggcucuggccggagcacuagaagcugagauggacggugccaaaggcaggcucucaagcgggcaccugaagugucggcuuaaaauggauaagcugcgcuugaaaggaguuaguuacucucucugcacugcggccuuuacauucaccaagauucccgcagagacucugcacggcacagugaccgucgaagugcaauaugcugguacggacgggccuuguaaaguaccagcccagauggcuguugauaugcagaccuuaacaccggugggccgacugaucacugccaaucccgucauaaccgagggaacagaaaacuccaagaugaugcucgagcuugacccuccauuuggcgauagcuacauugugaucggggucggagaaaagaaaauuacucaucacuggcauagaucggguucuaccaucggcaaggcauucgaggccacagugaggggagcuaaacggauggcgguucugggggacaccgcaugggauuuuggcuccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8524 - RNA, 1582 nt, Artificial Sequence
  KU744693.1 solE mRNA Design 3 opt
gggagaaagcuuaccaugagccagaaggugaucuaccuggucaugauucuccuuauagcccccgcuuauuccaucagaugcauuggcguuucuaacagggacuucguggaggggaugucaggagguaccuggguagaugugguccuggaacacggcgggugugugacagcaauggcccaagacaaaccuacuguugauaucgaguuggugacgaccacagucaguaauauggcggaagugcggagcuacugcuaugaggcuuccauuucugacauggccucggauucacgcuguccaacucagggagaagcauacuuagacaagcagagcgauacccaguauguaugcaaacgaacacugguugaccguggcugggguaacggguguggacuauuuggcaagggcagucucgugaccugcgccaaauucgcuuguuccaagaagaugacugggaaaucuauccaaccggagaaucuggaguacagaauaaugcuuagcguccauggaucccagcacucagguaugcuggugaacgauacaggccaugaaaccgacgagaauagggcaaagguggaaaucacgcccaacaguccucgggccgaggcuacucucgggggauuuggcagcuugggucuggauugcgagccacgcaccgggcuggacuucucugaucucuauuacuuaacaaugaauaacaaacacuggcuggcccauaaggaaugguuucacgacauuccccuuccuuggcacgcgggagcagccacuggcaccccacauuggaauaacaaagaggcuuuggucgaguucaaggacgcccacgcaaagagacagacaguugugguacugggcucccaggaaggggcugugcauaccgcccuagcgggagcccucgaagcagagauggauggugcuaaaggcaggcugucaagcgggcaccuuaagugucggcugaaaauggacaaguugcgccucaaaggagucaguuacucucugugcacggccgcuuuuacuuucacaaagauccccgccgagaccguggauggcacuguuacaguggaaggucaauaugggggcaccgacggaccuuguaaagucccagcacagauggccguggauaugcagacguuaaccccgguaggccgacugauuacagcuaaucccguuaucacugaguccaccgaaaacagcaagaugaugcucgagcuugacccuccauuuggggauucguacauagugauuggagucggugaaaagaaaaucacacaccauuggcacagaucuggcuccacuauugggaaggcguucgaggcaaccgugaggggagccaaacggauggcuguccugggcgacacagccugggauuuugguucaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8525 - RNA, 1582 nt, Artificial Sequence
  EU545988.1 solE mRNA Design 3 opt
gggagaaagcuuaccaugagccagaaggugaucuaccuggucaugauucuccuuauagcccccgcuuauuccaucagaugcauuggcguuucuaacagggacuucguggaggggaugucaggagguaccuggguagaugugguccuggaacacggcgggugugugacaguuauggcacaagacaaaccugccguggauaucgaguuggucacuacgaccgugaguaauauggcggaaguacggagcuacugcuaugaggcuuccauuucugacauggccucggauucacgcuguccaacacagggagaagcauacuuagacaagcagagcgauacucaguauguuugcaaacgaacccugguggaccguggcugggguaacggguguggacuauuuggcaagggcagucucgucacaugcgccaaauucgcuuguuccaagaagaugaccgggaaaucuauccaaccggagaaucuggaguacagaauaaugcuuagcgugcauggaucccagcacucagguaugaucgugaacgauacuggccaugaaacagacgagaauagggcaaaggucgaaauuacccccaacaguccucgggccgaggcuacgcugggaggguuuggcagcuugggucucgauugcgagccacgcacugggcuggacuucucugaucuguauuaccucaccaugaauaacaaacacugguuaguucauaaggaaugguuucacgacaucccccugccuuggcacgccggagcggacacaggcacuccacauuggaauaacaaagaggcacuuguggaguucaaggaugcccacgcuaagagacagaccguaguggucuugggcucccaggaaggggccgugcauacagcacuggcuggagcccuagaagcggagauggacggugccaaaggcaggcucucaagcgggcaccugaagugucggcuuaaaauggauaagcugcgcuugaaaggaguuaguuacucucucugcaccgcagcuuuuacguucacuaagauucccgccgagacacugcacggcaccgugacugucgaagugcaauaugcugguacagacgggccuuguaaaguaccagcccagauggcaguugauaugcagaccuuaacgccggugggccgacugaucaccgccaaucccgucauaacagaguccacugaaaacagcaagaugaugcucgagcuugacccuccauuuggagauucguacauugugaucggcgucggggaaaagaaaauuacccaucacuggcauagaucuggauccacaaucgguaaggcuuucgaggcgacugugaggggcgcaaaacggauggccguucugggggacaccgcuugggauuuuggaucaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8526 - RNA, 1582 nt, Artificial Sequence
  KY007221.1 solE mRNA Design 3 opt
gggagaaagcuuaccaugagccagaaggugaucuaccuggucaugauucuccuuauagcccccgcuuauuccaucagaugcauuggcguuaacaauagggacuucguggaggggaugucuggagguaccuggguagaugugguccuggaacacggcgggugugugacaguuauggcacaagacaaaccuacuguggauaucgaguuggucacgaccacagugucaaacauggccgaaguacggaguuacugcuaugaggcgagcauuuccgacauggcuucugauucgcgcuguccaacucagggagaagccuacuuagacaagcagucagauacccaguauguuugcaaacgaacacugguggaccguggcugggguaauggguguggacuauuuggcaagggcagccucgugaccugcgcaaaauucgccuguaguaagaagaugacugggaaauccauccaaccggagaaccuggaguacagaauaaugcuuucuguccauggaagccagcacuccgguaugaucgugaaugauacaggccaugaaaccgacgagaacagggcuaaggucgaaauuacgcccaauucaccucgggcagaggccacucugggaggguuuggcaguuugggucucgauugcgagccacgcaccgggcuggacuucagcgaucuguauuaccucacaaugaacaauaaacacugguuaguucauaaggaaugguuucacgacaucccccugccuuggcacgcuggagccgacacuggcaccccacauuggaacaauaaagaggcgcuuguggaguucaaggaugcacacgccaagagacagacaguaguggucuugggcucucaggaaggggcugugcauaccgcccuggcaggagcucuagaagccgagauggacggugcgaaaggcaggcucuccucagggcaccugaagugucggcuuaaaauggauaagcugcgcuugaaaggaguuagcuacagucucugcacggccgcauuuacuuucacaaagauucccgcugagacccugcacggcacugugacagucgaagugcaauaugccgguaccgacgggccuuguaaaguaccagcucagauggccguugauaugcagacguuaaccccggugggccgacugaucacagcaaaccccgucauaacugagucuaccgaaaauuccaagaugaugcucgagcuugacccuccauuuggagauagcuacauugugaucggcgucggggaaaagaaaauuacacaucacuggcauagaucgggaucuacuaucgguaaggccuucgaggcuaccgugaggggcgcgaaacggauggcaguucugggggacacagccugggauuuuggauccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8527 - RNA, 1582 nt, Artificial Sequence
  KY003152.1 solE mRNA Design 3 opt
gggagaaagcuuaccaugagccagaaggugaucuaccuggucaugauucuccuuauagcccccgcuuauuccaucagaugcauuggcguuucuaacagggacuucguggaggggaugucaggagguaccuggguagaugugguccuggaacacggcgggugugugacaguuauggcacaagacaaaccuacuguggauaucgaguuggucacgaccacagugaguaauauggccgaaguacggagcuacugcuaugaggcguccauuucugacauggcuucggauucacgcuguccaacucagggagaagccuacuuagacaagcagagcgauacccaguauguuugcaaacgaacacugguggaccguggcugggguaacggguguggacuauuuggcaagggcagucucgugaccugcgcaaaauucgccuguuccaagaagaugacugggaaaucuauccaaccggagaaucuggaguacagaauaaugcuuagcguccauggaucccagcacucagguaugaucgugaacgauacaggccaugaaaccgacgagaauagggcuaaggucgaaauuacgcccaacaguccucgggcagaggccacucugggaggguuuggcagcuugggucucgauugcgagccacgcaccgggcuggacuucucugaucuguauuaccucacaaugaauaacaaacacugguuaguucauaaggaaugguuucacgacaucccccugccuuggcacgcuggagccgacacuggcaccccacauuggaauaacaaagaggcgcuuguggaguucaaggaugcacacgccaagagacagacaguaguggucuugggcucccaggaaggggcugugcauaccgcccuggcaggagcucuagaagccgagauggacggugcgaaaggcaggcucucaagcgggcaccugaagugucggcuuaaaauggauaagcugcgcuugaaaggaguuaguuacucucucugcgccgcagcuuuuacguucacuaagauucccgccgagacacugcacggcaccgugacugucgaagugcaauaugcugguacagacgggccuuguaaaguaccagcccagauggcaguugauaugcagaccuuaacgccggugggccgacugaucaccgccaaucccgucauaacagaguccacugaaaacagcaagaugaugcucgagcuugacccuccauuuggagauucguacauugugaucggcgucggggaaaagaaaauuacccaucacuggcauagaucuggauccacaaucgguaaggcuuucgaggcgacugugaggggcgcaaaacggauggccguucugggggacaccgcuugggauuuuggaucaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8528 - RNA, 1582 nt, Artificial Sequence
  KX694533.2 solE mRNA Design 3 opt
gggagaaagcuuaccaugagccagaaggugaucuaccuggucaugauucuccuuauagcccccgcuuauuccaucagaugcauuggcguuucuaacagggacuucguggaggggaugucaggagguaccuggguagaugugguccuggaacacggcgggugugugacaguuauggcacaagacaaaccuacuguggauaucgaguuggucacgaccacagugaguaauauggccgaaguacggagcuacugcuaugaggcguccauuucugacauggcuucggauucacgcuguccaacucagggagaagccuacuuagacaagcagagcgauacccaguauguuugcaaacgaacacugguggaccguggcugggguaacggguguggacuauuuggcaagggcagucucgugaccugcgcaaaauucgccuguuccaagaagaugacugggaaaucuauccaaccggagaaucuggaguacagaauaaugcuuagcguccauggaucccagcacucagguaugaucgugaacgauauuggccaugaaacagacgagaauagggcuaaggucgaaaucacccccaacaguccucgggcagaggccacgcugggaggguuuggcagcuugggucucgauugcgagccacgcacugggcuggacuucucugaucuguauuaccucaccaugaauaacaaacacugguuaguucauaaggaaugguuucacgacauuccccugccuuggcacgcuggagccgacacaggcacuccacauuggaauaacaaagaggcgcuuguggaguucaaggaugcacacgccaagagacagaccguaguggucuugggcucccaggaaggggcugugcauacagcccuggcaggagcucuagaagccgagauggacggugcgaaaggcaggcucucaagcgggcaccugaagugucggcuuaaaauggauaagcugcgcuugaaaggaguuaguuacucucucugcaccgccgcauuuacguucacuaagauccccgcugagacacugcacggcaccgugacugucgaagugcaauaugccgguacagacgggccuuguaaaguaccagcucagauggccguugauaugcagaccuuaacgccggugggccgacugauaaccgcaaaucccgucauuacagaguccacugaaaacagcaagaugaugcucgagcuugacccuccauuuggagauucguacaucgugauuggcgucggggacaagaaaaucacccaucacuggcauagaucuggauccacaaucgguaaggccuucgaagcuacugugaggggcgcgaaacggauggcaguucugggggauaccgccugggacuuuggaucaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8529 - RNA, 1582 nt, Artificial Sequence
  KX601167.1 solE mRNA Design 3 opt
gggagaaagcuuaccaugagccagaaggugaucuaccuggucaugauucuccuuauagcccccgcuuauuccaucagaugcauuggcguuucuaacagggacuucguggaggggaugucaggagguaccuggguagaugugguccuggaacacggcgggugugugacaguuauggcacaagacaaaccuacuguggauaucgaguuggucacgaccacagugaguaauauggccgaaguacggagcuacugcuaugaggcguccauuucugacauggcuucggauucacgcuguccaacucagggagaagccuacuuagacaagcagagcgauacccaguauguuugcaaacgaacacugguggaccguggcugggguaacggguguggacuauuuggcaagggcagucucgugaccugcgcaaaauucgccuguuccaagaagaugacugggaaaucuauccaaccggagaaucuggaguacagaauaaugcuuagcguccauggaucccagcacucagguaugaucgugaacgauacaggccaugaaaccgacgagaauagggcuaaggucgaaauuacgcccaacaguccucgggcagaggccacucugggaggguuuggcagcuugggucucgauugcgagccacgcaccgggcuggacuucucugaucuguauuaccucacaaugaauaacaaacacugguuaguucauaaggaaugguuucacgacaucccccugccuuggcacgcuggagccgacacuggcaccccacauuggaauaacaaagaggcgcuuguggaguucaaggaugcacacgccaagagacagacaguaguggucuugggcucccaggaaggggcugugcauaccgcccuggcaggagcucuagaagccgagauggacggugcgaaaggcaggcucucaagcgggcaccugaagugucggcuuaaaauggauaagcugcgcuugaaaggaguuaguuacucucucugcacggccgcauuuacuuucacaaagauucccgcugagacccugcacggcacugugacagucgaagugcaauaugccgguaccgacgggccuuguaaaguaccagcucagauggccguugauaugcagacguuaaccccggugggccgacugaucacagcaaaucccgucauaacugaguccaccgaaaacagcaagaugaugcucgagcuugacccuccauuuggagauucguacauugugaucggcgucggggacaagaaaauuacacaucacugguauagaucuggauccacuaucgguaaggccuucgaagcuaccgugaggggcgcgaaacggauggcaguucugggggauacagccugggacuuuggaucaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8530 - RNA, 1582 nt, Artificial Sequence
  KY288905.1 solE mRNA Design 3 opt
gggagaaagcuuaccaugagccagaaggugaucuaccuggucaugauucuccuuauagcccccgcuuauuccaucagaugcauuggcguuucuaacagggacuucguggaggggaugucaggagguaccuggguagaugugguccuggaacacggcgggugugugacaguuauggcacaagacaaaccuacuguggauaucgaguuggucacgaccacagugaguaauauggccgaaguacggagcuacugcuaugaggcguccauuucugacauggcuucggauucacgcuguccaacucagggagaagccuacuuagacaagcagagcgauacccaguauguuugcaaacgaacacugguggaccguggcugggguaacggguguggacuauuuggcaagggcagucucgugaccugcgcaaaauucacuuguuccaagaagaugacagggaaaucuauccaaccggagaaucuggaguacagaauaaugcuuagcguccauggaucccagcacucagguaugaucgugaacgauaccggccaugaaacggacgagaauagggccaaggucgaaguuacucccaacaguccucgggcugaggcaacccugggaggguuuggcagcuugggucucgauugcgagccacgcacagggcuggacuucucugaucuguauuaccucacuaugaauaacaaacacugguuagugcauaaggaaugguuucacgacauuccccugccuuggcacgccggagcugacaccggcacaccacauuggaauaacaaagaggcccuuguagaguucaaggaugcgcacgcaaagagacagaccguggucguguugggcucccaggaaggggccguucauacggcucuggccggagcacuagaagcugagauggacggugccaaaggcaggcucuuuucagggcaccugaagugucggcuuaaaauggauaagcugcgcuugaaaggagugagcuacagucucugcacugcggccuucacauuuaccaagguccccgcagagacucugcacggcacagugaccguagaaguucaauaugcugguacggacgggccuuguaaagugccagcccagauggcugucgauaugcagaccuuaacaccggugggccgacugaucacugccaaucccgucauuaccgagucuacagaaaacuccaagaugaugcucgagcuugacccuccauucggagauagcuacaucgugauaggcguuggggacaagaaaauuacucaucacuggcauagaucgggaucuaccaucgguaaggcauuugaagccacagugaggggcgcuaaacggauggcgguacugggggauaccgcaugggacuucggauccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8531 - RNA, 1582 nt, Artificial Sequence
  KF268950.1 solE mRNA Design 3 opt
gggagaaagcuuaccaugagccagaaggugaucuaccuggucaugauucuccuuauagcccccgcuuauuccaucagaugcauuggcguuucuaacagggacuucguggaggggaugucaggagguaccuggguagaugugguccuggaacacggcgggugugugacaguuauggcacaagacaaaccuacuguggauaucgaguuggucacgaccacagugaguaauauggccgaaguacggagcuacugcuaugaggcguccauuucugacauggcuucggauucacgcuguccaacucagggagaagccuacuuagacaagcagagcgauacccaguauguuugcaaacgaacacugguggaccguggcugggguaacggguguggacuauuuggcaagggcagucucgugaccugcgcaaaauucacuuguuccaagaagaugacagggaaaucuauccaaccggagaaucuggaguacagaauaaugcuuagcguccauggaucccagcacucagguaugaucgugaacgauauuggccaugaaaccgacgagaauagggccaaggucgaaguuacgcccaacaguccucgggcugaggcaacucugggaggguuuggcagcuugggucucgauugcgagccacgcaccgggcuggacuucucugaucuguauuaccucacaaugaauaacaaacacugguuagugcauaaggaaugguuucacgacaucccccugccuuggcacgccggagcugacacuggcaccccacauuggaauaacaaagaggcccuuguagaguucaaggaugcgcacgcaaagagacagacaguggucguguugggcucccaggaaggggccguucauaccgcucuggccggagcacuagaagcugagauggacggugccaaaggcaggcucuuuucagggcaccugaagugucggcuuaaaauggauaagcugcgcuugaaaggagugagcuacagucucugcacggcggccuucacuuuuacaaagguccccgcagagacccugcacggcacugugacaguagaaguucaauaugcugguaccgacgggccuuguaaagugccagcccagauggcugucgauaugcagacguuaaccccggugggccgacugauuacagccaaucccgucaucacugagucuaccgaaaacuccaagaugaugcucgagcuugacccuccauucggagauagcuacauagugauuggcguuggggacaagaaaaucacacaucacuggcauagaucgggaucuacuauugguaaggcauuugaagccaccgugaggggcgcuaaacggauggcgguacugggggauacagcaugggacuucggauccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8532 - RNA, 1582 nt, Artificial Sequence
  KF383116.1 solE mRNA Design 3 opt
gggagaaagcuuaccaugagccagaaggugaucuaccuggucaugauucuccuuauagcccccgcuuauuccaucagaugcauuggcguuucuaacagggacuucguggaggggaugucaggagguaccuggguagaugugguccuggaacacggcgggugugugacaguuauggcacaagacaaaccuacuguggauaucgaguuggucacgaccacagugaguaauauggccgaaguacggagcuacugcuaugaggcguccauuucugacauggcuucggauucacgcuguccaacucagggagaagccuacuuagacaagcagagcgauacccaguauguuugcaaacgaacacugguggaccguggcugggguaacggguguggacuauuuggcaagggcagucucgugaccugcgcaaaauucacuuguuccaagaagaugacagggaaaucuauccaaccggagaaucuggaguacagaauaaugcuuagcguccauggaucccagcacucagguaugaucgugaacgauauuggccaugaaaccgacgagaauagggccaaggucgaaguuacgcccaacaguccucgggcugaggcaacucugggaggguuuggcagcuugggucucgauugcgagccacgcaccgggcuggacuucucugaucuguauuaccucacaaugaauaacaaacacugguuagugcauaaggaaugguuucacgacaucccccugccuuggcacgccggagcugacacuggcaccccacauuggaauaacaaagaggcccuuguagaguucaaggaugcgcacgcaaagagacagacaguggucguguugggcucccaggaaggggccguucauaccgcucuggccggagcacuagaagcugagauggacggugccaaaggcaggcucuuuucagggcaccugaagugucggcuuaaaauggauaagcugcgcuugaaaggagugagcuacagucucugcacggcggucuguacugccgcaaaggugcccgcugagacacugcacggcaccguaacuguugaagugcaauaugccgguacagacgggccuugcaaagucccagcucagauggccguggauaugcagaccuuaacgccggucggccgacugauuaccgcaaaucccgugaucacagagucuacugaaaacuccaagaugaugcucgagcuugacccuccauucggagauagcuacauaguuauuggcgugggggacaagaaaaucacccaucacuggcauagaucgggaucuacaauugguaaggccuuugaagcuacuguaaggggcgcgaaacggauggcaguccugggggauaccgccugggacuucggauccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8533 - RNA, 1564 nt, Artificial Sequence
  KU963574.2 solE mRNA Design 3 opt
gggagaaagcuuaccaugagccagaaggugaucuaccuggucaugauucuccuuauagcccccgcuuauuccaucagaugcauuggcguuucuaacagggacuucguggaggggaugucaggagguaccuggguagaugugguccuggaacacggcgggugugugacaguuauggcacaagacaaaccuacuguggauaucgaguuggucacgaccacagugaguaauauggccgaaguacggagcuacugcuaugaggcguccauuucugacauggcuucggauucacgcuguccaacucagggagaagccuacuuagacaagcagagcgauacccaguauguuugcaaacgaacacugguggaccguggcugggguaacggguguggacuauuuggcaagggcagucucgugaccugcgcaaaauucacuuguuccaagaagaugacagggaaaucuauccaaccggagaaucuggaguacagaauaaugcuuagcguccauggaucccagcacucagguaugaucgugaacgaugaaaauagggccaaggucgagguuacccccaacaguccucgggcugaagcaacgcugggcggguuuggcagcuugggacucgacugcgagccacgcacuggucuggauuucucugaccuguauuaccucaccaugaauaacaaacauugguuagugcacaaggagugguuucaugauauuccccugccuuggcacuccggggccgacacagaaacuccacacuggaauaacaaagaggcucuuguagaguucaaggacgcccaugcgaagagacagaccguggucguguugggaucacaggaaggcgcaguucacacagcccuggcuggcgcccuagaagcagagauggauggggcuaaaggaaggcucagcaguggucaucugaagugucggcuuaaaauggacaagcugcgcuugaaaggcgugucuuacucccucugcaccgccgcguuuacguucacuaagguccccgccgagacacugcacgggaccgugacuguagaaguucaauaugcaggacgagauggcccuuguaaagugccagcucagauggccgucgacaugcagacauuaaccccgguggguagacugaucacggcuaaucccgucauuaccgagagcacagaaaacucgaagaugaugcucgagcuugauccuccauuuggggacucuuacaucgugauaggcguuggagauaagaaaauuacucaccauuggcacagguccggcucaaucauugggaaggccuucgaagcaaccgugcggggagccaaacguauggcuguacugggugacacagcgugggauuuuggcaguugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8534 - RNA, 1582 nt, Artificial Sequence
  KF383118.1 solE mRNA Design 3 opt
gggagaaagcuuaccaugagccagaaggugaucuaccuggucaugauuguucucauagugcccgccuauuccaucucuugcauuggcguaucaaacagagaccuuguggaggggaugaguggagguaccugggucgaugugguucuggaacacggcgggugugugacagagauggcucaagacaaaccuacugucgauaucgaauuggugacgaugaccguaagcaauauggcagagguuagguccuacugcuaugaagccucuuuaucggacauggcgucagcuagccgguguccaacacagggagagccgagucuggauaagcaguccgacacucagucugugugcaaacgcacccuaggcgaucgagguugggggaacggauguggcauuuucggcaaggggagccucgucacaugcuccaaauuuaccuguugcaagaagaugcccggaaaaucaauccaaccugagaaucuggaauaccguauaaugcuuccagugcaugguagucagcacagcggcaugaucgugaacgacauugggcaugagacugaugaaaauagagccaaggucgagguuacacccaacucuccuagggcagaggccacccugggaggcuucgguuccuuggggcucgacugugaaccacggacgggacuggauuuuucagaccuguauuaccucacuaugaauaacaaacacugguuagugcauaaggagugguuccacgauaucccccugccuuggcacgcuggcgcagacaccggcacaccacauuggaauaacaaagaagcccuuguagaguuuaaggacgcucacgccaagcgccagacuguggucguguuggggagccaggaaggagcgguucauaccgcacuggccggugcucuagaggccgagauggauggcgcaaaagggagacucuucaguggacaccugaagugcaggcuuaaaauggacaagcugcgguugaaaggcgugucuuauucccucuguacagcugccuuuaccuucacgaaggucccggcggaaacucugcacgguacagugaccguagagguucaaagcgccgggacugauggccccugcaaagugccugcacagauggcugucgacaugcagacauuaaccccagugggacgccugauuacggccaaucccgucaucaccgaaucgacagagaacucuaagaugaugcucgaacuugauccuccauuuggcgacuccuacauagugauugggguuggagauaagaaaaucacucaucacuggcaucgaucagguaguaccauuggcaaggcuuucgaggccacagugagaggggcaaaaaggauggccguacugggagacacugcuugggauuuuggcagcugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8535 - RNA, 1582 nt, Artificial Sequence
  KX520666.1 solE mRNA Design 3 opt
gggagaaagcuuaccaugagacagaaggugaucuaccuggucaugauucuccuuauagcccccgcuuauagcaucaggugcauuggcguuuccaaccgggacuucguggaggggaugucuggagguaccuggguagaugugguccuggaacacggcgggugugugacaguuauggcacaagacaaaccuacuguggauaucgaguuggucacgaccacagugucaaauauggccgaaguacgcaguuacugcuaugaggcgagcauuuccgacauggcuucugauucgcgauguccaacucagggagaagccuacuuagacaagcagucagauacccaguauguuugcaaacguacacugguggacagaggcugggguaacggguguggacuauuuggcaagggcagccucgugaccugcgcaaaauucgccuguaguaagaagaugacugggaaauccauccaaccggagaaucuggaguacaggauaaugcuuucuguccauggaagccagcacuccgguaugaucgugaacgauacaggccaugaaaccgacgagaaucgggcuaaggucgaaauuacgcccaacucaccucgcgcagaggccacucugggaggguuuggcaguuugggucucgauugcgagccaagaaccgggcuggacuucagcgaucuguauuaccucacaaugaauaacaaacacugguuaguucauaaggaaugguuucacgacaucccccugccuuggcacgcuggagccgacacuggcaccccacauuggaauaacaaagaggcgcuuguggaguucaaggaugcacacgccaagaggcagacaguaguggucuugggcucucaggaaggggcugugcauaccgcccuggcaggagcucuagaagccgagauggacggugcgaaaggccggcucuccucagggcaccugaagugucgccuuaaaauggauaagcugcgauugaaaggaguuagcuacagucucugcacggccgcauuuacuuucacaaagauucccgcugagacccugcacggcacugugacagucgaagugcaauaugccgguaccgacgggccuuguaaaguaccagcucagauggccguugauaugcagacguuaaccccggugggcagacugaucacagcaaaucccgucauaacugagucuaccgaaaacuccaagaugaugcucgagcuugacccuccauuuggagauagcuacauugugaucggcgucggggaaaagaaaauuacacaucacuggcauaggucgggaucuacuaucgguaaggccuucgaggcuaccgugcggggcgcgaaacguauggcaguucugggggacacagccugggauuuuggauccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8536 - RNA, 1582 nt, Artificial Sequence
  KF383120.1 solE mRNA Design 3 opt
gggagaaagcuuaccaugagccagagagugaucuaccuggucaugauucuccuuauagcccccgcuuauuccaucaggugcauuggcguuucuaaccgggacuucguggaggggaugucaggagguaccuggguagaugugguccuggaacacggcgggugugugacaguuauggcacaagacaagccuacuguggauaucgaguuggucacgaccacagugaguaauauggccgaaguacgcagcuacugcuaugaggcguccauuucugacauggcuucggauucacgauguccaacucagggagaagccuacuuagacaaacagagcgauacccaguauguuugcaagcguacacugguggacagaggcugggguaacggguguggacuauuuggcaaaggcagucucgugaccugcgcaaaguucacuuguuccaaaaagaugacagggaagucuauccaaccggagaaucuggaguacaggauaaugcuuagcguccauggaucccagcacucagguaugaucgugaacgauauuggccaugaaaccgacgagaaucgggccaaagucgaaguuacgcccaacaguccucgcgcugaggcaacucugggaggguuuggcagcuugggucucgauugcgagccaagaaccgggcuggacuucucugaucuguauuaccucacaaugaauaacaagcacugguuagugcauaaagaaugguuucacgacaucccccugccuuggcacgccggagcugacacuggcaccccacauuggaauaacaaggaggcccuuguagaguucaaagaugcgcacgcaaagaggcagacaguggucguguugggcucccaggaaggggccguucauaccgcucuggccggagcacuagaagcugagauggacggugccaagggccggcucuuuucagggcaccugaaaugucgcauuaagauggauaaacuucgacugaagggagugagcuacaguuugugcacggcggccuucacuuuuucuaaaguccccgcagagacacuccacggcaccgugacuguagaaguucaauaugcugguagagacgggccuuguaaggugccagcccagauggcugucgauaugcagacacugaccccggugggcagguuaaucacggccaaucccauaauuaccgaguccacagaaaacagccggaugaugcuggagcucgacccuccauucggagauucguacaucgucauuggcgugggggacaaaaagaucacucaucacuggcaucguucuggauccaccaucgguaaggcauuugaagccacaguucgcggcgcuaaaagaauggcggugcuuggggauacugcaugggacuucggaucaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8537 - RNA, 2365 nt, Artificial Sequence
  ZIKV (strain ZikaSPH2015) Polyprotein(93-804) mRNA Design 3 opt
gggagaaagcuuaccaugagaaucaucaacgccagaaaggagaagaagagaagaggcgccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacgugggcugcagcguggacuucagcaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8538 - RNA, 2365 nt, Artificial Sequence
  ZIKV (isolate Z1106033) Polyprotein(93-804) mRNA Design 3 opt
gggagaaagcuuaccaugagaaucaucaacgccagaaaggagaagaagagaagaggcgccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaccugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacgccaagaacggcagcaucagccugaugugccuggcccugggcggcgugcugaucuuccugagcaccgccgugagcgccgacgugggcugcagcguggacuucagcaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8539 - RNA, 2353 nt, Artificial Sequence
  ZIKV (strain MR 766) Polyprotein(93-800) mRNA Design 3 opt
gggagaaagcuuaccaugagaaucaucaacgccagaaaggagagaaagagaagaggcgccgacaccagcaucggcaucaucggccugcugcugaccaccgccauggccgccgagaucaccagaagaggcagcgccuacuacauguaccuggacagaagcgacgccggcaaggccaucagcuucgccaccacccugggcgugaacaagugccacgugcagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucaagguggagaacuggaucuucagaaaccccggcuucgcccugguggccguggccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucaccugcagcaagaagaugaccggcaagagcauccagcccgagaaccuggaguacagaaucaugcugagcgugcacggcagccagcacagcggcaugaucggcuacgagaccgacgaggacagagccaagguggaggugacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacuguucagcggccaccugaagugcagacugaagauggacaagcugagacugaagggcgugagcuacagccugugcaccgccgccuucaccuucaccaaggugcccgccgagacccugcacggcaccgugaccguggaggugcaguacgccggcaccgacggccccugcaagauccccgugcagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgacaagaagaucacccaccacuggcacagaagcggcagcaccaucggcaaggccuucgaggccaccgugagaggcgccaagagaauggccgugcugggcgacaccgccugggacuucggcagcgugggcggcguguucaacagccugggcaagggcauccaccagaucuucggcgccgccuucaagagccuguucggcggcaugagcugguucagccagauccugaucggcacccugcugguguggcugggccugaacaccaagaacggcagcaucagccugaccugccuggcccugggcggcgugaugaucuuccugagcaccgccgugagcgccgacgugggcugcagcguggacuucagcaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8540 - RNA, 2365 nt, Artificial Sequence
  ZIKV (strain NatalRGN) Polyprotein(93-804) mRNA Design 3 opt
gggagaaagcuuaccaugagaaucaucaacgccagaaaggagaagaagagaagaggcgccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacgugggcugcagcguggacuucagcaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8541 - RNA, 2290 nt, Artificial Sequence
  ZIKV (strain ZikaSPH2015) Polyprotein(108-794) mRNA Design 3 opt
gggagaaagcuuaccaugaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8542 - RNA, 2290 nt, Artificial Sequence
  ZIKV (isolate Z1106033) Polyprotein(108-794) mRNA Design 3 opt
gggagaaagcuuaccaugaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaccugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacgccaagaacggcagcaucagccugaugugccuggcccugggcggcgugcugaucuuccugagcaccgccgugagcgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8543 - RNA, 2278 nt, Artificial Sequence
  ZIKV (strain MR 766) Polyprotein(108-790) mRNA Design 3 opt
gggagaaagcuuaccaugaccagcaucggcaucaucggccugcugcugaccaccgccauggccgccgagaucaccagaagaggcagcgccuacuacauguaccuggacagaagcgacgccggcaaggccaucagcuucgccaccacccugggcgugaacaagugccacgugcagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucaagguggagaacuggaucuucagaaaccccggcuucgcccugguggccguggccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucaccugcagcaagaagaugaccggcaagagcauccagcccgagaaccuggaguacagaaucaugcugagcgugcacggcagccagcacagcggcaugaucggcuacgagaccgacgaggacagagccaagguggaggugacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacuguucagcggccaccugaagugcagacugaagauggacaagcugagacugaagggcgugagcuacagccugugcaccgccgccuucaccuucaccaaggugcccgccgagacccugcacggcaccgugaccguggaggugcaguacgccggcaccgacggccccugcaagauccccgugcagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgacaagaagaucacccaccacuggcacagaagcggcagcaccaucggcaaggccuucgaggccaccgugagaggcgccaagagaauggccgugcugggcgacaccgccugggacuucggcagcgugggcggcguguucaacagccugggcaagggcauccaccagaucuucggcgccgccuucaagagccuguucggcggcaugagcugguucagccagauccugaucggcacccugcugguguggcugggccugaacaccaagaacggcagcaucagccugaccugccuggcccugggcggcgugaugaucuuccugagcaccgccgugagcgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8544 - RNA, 2290 nt, Artificial Sequence
  ZIKV (strain NatalRGN) Polyprotein(108-794) mRNA Design 3 opt
gggagaaagcuuaccaugaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8545 - RNA, 1582 nt, Artificial Sequence
  ZIKV (strain ZikaSPH2015) Polyprotein(273-723) mRNA Design 3 opt
gggagaaagcuuaccaugagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8546 - RNA, 1582 nt, Artificial Sequence
  ZIKV (isolate Z1106033) Polyprotein(273-723) mRNA Design 3 opt
gggagaaagcuuaccaugagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8547 - RNA, 1570 nt, Artificial Sequence
  ZIKV (strain MR 766) Polyprotein(273-719) mRNA Design 3 opt
gggagaaagcuuaccaugagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucaccugcagcaagaagaugaccggcaagagcauccagcccgagaaccuggaguacagaaucaugcugagcgugcacggcagccagcacagcggcaugaucggcuacgagaccgacgaggacagagccaagguggaggugacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacuguucagcggccaccugaagugcagacugaagauggacaagcugagacugaagggcgugagcuacagccugugcaccgccgccuucaccuucaccaaggugcccgccgagacccugcacggcaccgugaccguggaggugcaguacgccggcaccgacggccccugcaagauccccgugcagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgacaagaagaucacccaccacuggcacagaagcggcagcaccaucggcaaggccuucgaggccaccgugagaggcgccaagagaauggccgugcugggcgacaccgccugggacuucggcagcugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8548 - RNA, 1582 nt, Artificial Sequence; identical to SEQ ID NO: 8546
  ZIKV (strain NatalRGN) Polyprotein(273-723) mRNA Design 3 opt

SEQ ID NO: 8549 - RNA, 2290 nt, Artificial Sequence
  ZIKV (strain ZikaSPH2015) Polyprotein(108-794)(F398S) mRNA Design 3 opt
gggagaaagcuuaccaugaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccugagcggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8550 - RNA, 2290 nt, Artificial Sequence
  ZIKV (isolate Z1106033) Polyprotein(108-794)(F398S) mRNA Design 3 opt
gggagaaagcuuaccaugaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaccugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccugagcggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacgccaagaacggcagcaucagccugaugugccuggcccugggcggcgugcugaucuuccugagcaccgccgugagcgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8551 - RNA, 2278 nt, Artificial Sequence
  ZIKV (strain MR 766) Polyprotein(108-790)(F398S) mRNA Design 3 opt
gggagaaagcuuaccaugaccagcaucggcaucaucggccugcugcugaccaccgccauggccgccgagaucaccagaagaggcagcgccuacuacauguaccuggacagaagcgacgccggcaaggccaucagcuucgccaccacccugggcgugaacaagugccacgugcagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucaagguggagaacuggaucuucagaaaccccggcuucgcccugguggccguggccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccugagcggcaagggcagccuggugaccugcgccaaguucaccugcagcaagaagaugaccggcaagagcauccagcccgagaaccuggaguacagaaucaugcugagcgugcacggcagccagcacagcggcaugaucggcuacgagaccgacgaggacagagccaagguggaggugacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacuguucagcggccaccugaagugcagacugaagauggacaagcugagacugaagggcgugagcuacagccugugcaccgccgccuucaccuucaccaaggugcccgccgagacccugcacggcaccgugaccguggaggugcaguacgccggcaccgacggccccugcaagauccccgugcagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgacaagaagaucacccaccacuggcacagaagcggcagcaccaucggcaaggccuucgaggccaccgugagaggcgccaagagaauggccgugcugggcgacaccgccugggacuucggcagcgugggcggcguguucaacagccugggcaagggcauccaccagaucuucggcgccgccuucaagagccuguucggcggcaugagcugguucagccagauccugaucggcacccugcugguguggcugggccugaacaccaagaacggcagcaucagccugaccugccuggcccugggcggcgugaugaucuuccugagcaccgccgugagcgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8552 - RNA, 2290 nt, Artificial Sequence
  ZIKV (strain NatalRGN) Polyprotein(108-794)(F399S) mRNA Design 3 opt
gggagaaagcuuaccaugaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccugagcggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8553 - RNA, 2290 nt, Artificial Sequence
  ZIKV (strain ZikaSPH2015) Polyprotein(108-794)(N444Q) mRNA Design 3 opt
gggagaaagcuuaccaugaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugcaggacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8554 - RNA, 2290 nt, Artificial Sequence
  ZIKV (isolate Z1106033) Polyprotein(108-794)(N444Q) mRNA Design 3 opt
gggagaaagcuuaccaugaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaccugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugcaggacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacgccaagaacggcagcaucagccugaugugccuggcccugggcggcgugcugaucuuccugagcaccgccgugagcgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8555 - RNA, 2290 nt, Artificial Sequence
  ZIKV (strain NatalRGN) Polyprotein(108-794)(N444Q) mRNA Design 3 opt
gggagaaagcuuaccaugaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugcaggacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8556 - RNA, 2290 nt, Artificial Sequence
  ZIKV (strain ZikaSPH2015) Polyprotein(108-694)-Cterm-JAEV1-E(400-500) mRNA Design 3 opt
gggagaaagcuuaccaugaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcacccugggcaaggccuucagcaccacccugaagggcgcccagagacuggccgcccugggcgacaccgccugggacuucggcagcaucggcggcguguucaacagcaucggcagagccgugcaccagguguucggcggcgccuucagaacccuguucggcggcaugagcuggaucacccagggccugaugggcgcccugcugcuguggaugggcgugaacgccagagacagaagcaucgcccuggccuuccuggccaccggcggcgugcugguguuccuggccaccaacgugcacgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8557 - RNA, 2290 nt, Artificial Sequence
  ZIKV (isolate Z1106033) Polyprotein(108-694)-Cterm-JAEV1-E(400-500) mRNA Design 3 opt
gggagaaagcuuaccaugaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaccugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcacccugggcaaggccuucagcaccacccugaagggcgcccagagacuggccgcccugggcgacaccgccugggacuucggcagcaucggcggcguguucaacagcaucggcagagccgugcaccagguguucggcggcgccuucagaacccuguucggcggcaugagcuggaucacccagggccugaugggcgcccugcugcuguggaugggcgugaacgccagagacagaagcaucgcccuggccuuccuggccaccggcggcgugcugguguuccuggccaccaacgugcacgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8558 - RNA, 2278 nt, Artificial Sequence
  ZIKV (strain MR 766) Polyprotein(108-690)-Cterm-JAEV1-E(400-500) mRNA Design 3 opt
gggagaaagcuuaccaugaccagcaucggcaucaucggccugcugcugaccaccgccauggccgccgagaucaccagaagaggcagcgccuacuacauguaccuggacagaagcgacgccggcaaggccaucagcuucgccaccacccugggcgugaacaagugccacgugcagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucaagguggagaacuggaucuucagaaaccccggcuucgcccugguggccguggccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucaccugcagcaagaagaugaccggcaagagcauccagcccgagaaccuggaguacagaaucaugcugagcgugcacggcagccagcacagcggcaugaucggcuacgagaccgacgaggacagagccaagguggaggugacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacuguucagcggccaccugaagugcagacugaagauggacaagcugagacugaagggcgugagcuacagccugugcaccgccgccuucaccuucaccaaggugcccgccgagacccugcacggcaccgugaccguggaggugcaguacgccggcaccgacggccccugcaagauccccgugcagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgacaagaagaucacccaccacuggcacagaagcggcagcacccugggcaaggccuucagcaccacccugaagggcgcccagagacuggccgcccugggcgacaccgccugggacuucggcagcaucggcggcguguucaacagcaucggcagagccgugcaccagguguucggcggcgccuucagaacccuguucggcggcaugagcuggaucacccagggccugaugggcgcccugcugcuguggaugggcgugaacgccagagacagaagcaucgcccuggccuuccuggccaccggcggcgugcugguguuccuggccaccaacgugcacgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8559 - RNA, 2290 nt, Artificial Sequence
  ZIKV (strain NatalRGN) Polyprotein(108-694)-Cterm-JAEV1-E(400-500) mRNA Design 3 opt
gggagaaagcuuaccaugaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcacccugggcaaggccuucagcaccacccugaagggcgcccagagacuggccgcccugggcgacaccgccugggacuucggcagcaucggcggcguguucaacagcaucggcagagccgugcaccagguguucggcggcgccuucagaacccuguucggcggcaugagcuggaucacccagggccugaugggcgcccugcugcuguggaugggcgugaacgccagagacagaagcaucgcccuggccuuccuggccaccggcggcgugcugguguuccuggccaccaacgugcacgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8560 - RNA, 2365 nt, Artificial Sequence; identical to SEQ ID NO: 8537
  ZIKV (strain ZikaSPH2015) Polyprotein(93-804) mRNA Design 3 opt

SEQ ID NO: 8561 - RNA, 2362 nt, Artificial Sequence
  ZIKV prME variant mRNA Design 3 opt
gggagaaagcuuaccaugaucaucaacgccagaaaggagaagaagagaagaggcgccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacgugggcugcagcguggacuucagcaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8562 - RNA, 2359 nt, Artificial Sequence
  ZIKV prME variant mRNA Design 3 opt
gggagaaagcuuaccaugaucaacgccagaaaggagaagaagagaagaggcgccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacgugggcugcagcguggacuucagcaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8563 - RNA, 2356 nt, Artificial Sequence
  ZIKV prME variant mRNA Design 3 opt
gggagaaagcuuaccaugaacgccagaaaggagaagaagagaagaggcgccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacgugggcugcagcguggacuucagcaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8564 - RNA, 2353 nt, Artificial Sequence
  ZIKV prME variant mRNA Design 3 opt
gggagaaagcuuaccauggccagaaaggagaagaagagaagaggcgccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacgugggcugcagcguggacuucagcaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8565 - RNA, 2350 nt, Artificial Sequence
  ZIKV prME variant mRNA Design 3 opt
gggagaaagcuuaccaugagaaaggagaagaagagaagaggcgccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacgugggcugcagcguggacuucagcaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8566 - RNA, 2347 nt, Artificial Sequence
  ZIKV prME variant mRNA Design 3 opt
gggagaaagcuuaccaugaaggagaagaagagaagaggcgccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacgugggcugcagcguggacuucagcaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8567 - RNA, 2344 nt, Artificial Sequence
  ZIKV prME variant mRNA Design 3 opt
gggagaaagcuuaccauggagaagaagagaagaggcgccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacgugggcugcagcguggacuucagcaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8568 - RNA, 2341 nt, Artificial Sequence
  ZIKV prME variant mRNA Design 3 opt
gggagaaagcuuaccaugaagaagagaagaggcgccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacgugggcugcagcguggacuucagcaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8569 - RNA, 2338 nt, Artificial Sequence
  ZIKV prME variant mRNA Design 3 opt
gggagaaagcuuaccaugaagagaagaggcgccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacgugggcugcagcguggacuucagcaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8570 - RNA, 2335 nt, Artificial Sequence
  ZIKV prME variant mRNA Design 3 opt
gggagaaagcuuaccaugagaagaggcgccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacgugggcugcagcguggacuucagcaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8571 - RNA, 2332 nt, Artificial Sequence
  ZIKV prME variant mRNA Design 3 opt
gggagaaagcuuaccaugagaggcgccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacgugggcugcagcguggacuucagcaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8572 - RNA, 2329 nt, Artificial Sequence
  ZIKV prME variant mRNA Design 3 opt
gggagaaagcuuaccaugggcgccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacgugggcugcagcguggacuucagcaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8573 - RNA, 2326 nt, Artificial Sequence
  ZIKV prME variant mRNA Design 3 opt
gggagaaagcuuaccauggccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacgugggcugcagcguggacuucagcaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8574 - RNA, 2323 nt, Artificial Sequence
  ZIKV prME variant mRNA Design 3 opt
gggagaaagcuuaccauggacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacgugggcugcagcguggacuucagcaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8575 - RNA, 2320 nt, Artificial Sequence
  ZIKV prME variant mRNA Design 3 opt
gggagaaagcuuaccaugaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacgugggcugcagcguggacuucagcaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8576 - RNA, 2320 nt, Artificial Sequence
  ZIKV prME variant mRNA Design 3 opt
gggagaaagcuuaccaugaccagcgugggcaucgugggccugcugcugaccaccgccauggccgccgccgugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacgugggcugcagcguggacuucagcaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8577 - RNA, 2332 nt, Artificial Sequence
  ZIKV prME variant mRNA Design 3 opt
gggagaaagcuuaccaugagaggcgccgacaccagcgugggcaucgugggccugcugcugaccaccgccauggccgccgccgugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacgugggcugcagcguggacuucagcaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8578 - RNA, 2356 nt, Artificial Sequence
  ZIKV prME variant mRNA Design 3 opt
gggagaaagcuuaccaugagaggccugagcagcagaaagagaagaagccacgacgugcugaccgugcaguuccugauccugggcaugcugcugaugaccggcggcgugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacgugggcugcagcguggacuucagcaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8579 - RNA, 2356 nt, Artificial Sequence
  ZIKV prME variant mRNA Design 3 opt
gggagaaagcuuaccaugagaggccugagcagcagaaagagaagaagccacgacgugcugaccgugcaguuccugauccugggcaugcugcugaugaccggcgccgugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacgugggcugcagcguggacuucagcaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8580 - RNA, 2347 nt, Artificial Sequence
  ZIKV prME variant mRNA Design 3 opt
gggagaaagcuuaccaugagaaucaucaacgccagaaaggagaagaagagaagaggcgccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacgugggcugcugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8581 - RNA, 2344 nt, Artificial Sequence
  ZIKV prME variant mRNA Design 3 opt
gggagaaagcuuaccaugaucaucaacgccagaaaggagaagaagagaagaggcgccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacgugggcugcugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8582 - RNA, 2341 nt, Artificial Sequence
  ZIKV prME variant mRNA Design 3 opt
gggagaaagcuuaccaugaucaacgccagaaaggagaagaagagaagaggcgccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacgugggcugcugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8583 - RNA, 2338 nt, Artificial Sequence
  ZIKV prME variant mRNA Design 3 opt
gggagaaagcuuaccaugaacgccagaaaggagaagaagagaagaggcgccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacgugggcugcugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8584 - RNA, 2335 nt, Artificial Sequence
  ZIKV prME variant mRNA Design 3 opt
gggagaaagcuuaccauggccagaaaggagaagaagagaagaggcgccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacgugggcugcugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8585 - RNA, 2332 nt, Artificial Sequence
  ZIKV prME variant mRNA Design 3 opt
gggagaaagcuuaccaugagaaaggagaagaagagaagaggcgccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacgugggcugcugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8586 - RNA, 2329 nt, Artificial Sequence
  ZIKV prME variant mRNA Design 3 opt
gggagaaagcuuaccaugaaggagaagaagagaagaggcgccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacgugggcugcugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8587 - RNA, 2326 nt, Artificial Sequence
  ZIKV prME variant mRNA Design 3 opt
gggagaaagcuuaccauggagaagaagagaagaggcgccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacgugggcugcugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8588 - RNA, 2323 nt, Artificial Sequence
  ZIKV prME variant mRNA Design 3 opt
gggagaaagcuuaccaugaagaagagaagaggcgccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacgugggcugcugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8589 - RNA, 2320 nt, Artificial Sequence
  ZIKV prME variant mRNA Design 3 opt
gggagaaagcuuaccaugaagagaagaggcgccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacgugggcugcugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8590 - RNA, 2317 nt, Artificial Sequence
  ZIKV prME variant mRNA Design 3 opt
gggagaaagcuuaccaugagaagaggcgccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacgugggcugcugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8591 - RNA, 2314 nt, Artificial Sequence
  ZIKV prME variant mRNA Design 3 opt
gggagaaagcuuaccaugagaggcgccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacgugggcugcugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8592 - RNA, 2311 nt, Artificial Sequence
  ZIKV prME variant mRNA Design 3 opt
gggagaaagcuuaccaugggcgccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacgugggcugcugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8593 - RNA, 2308 nt, Artificial Sequence
  ZIKV prME variant mRNA Design 3 opt
gggagaaagcuuaccauggccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacgugggcugcugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8594 - RNA, 2305 nt, Artificial Sequence
  ZIKV prME variant mRNA Design 3 opt
gggagaaagcuuaccauggacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacgugggcugcugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8595 - RNA, 2302 nt, Artificial Sequence
  ZIKV prME variant mRNA Design 3 opt
gggagaaagcuuaccaugaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacgugggcugcugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8596 - RNA, 2302 nt, Artificial Sequence
  ZIKV prME variant mRNA Design 3 opt
gggagaaagcuuaccaugaccagcgugggcaucgugggccugcugcugaccaccgccauggccgccgccgugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacgugggcugcugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8597 - RNA, 2314 nt, Artificial Sequence
  ZIKV prME variant mRNA Design 3 opt
gggagaaagcuuaccaugagaggcgccgacaccagcgugggcaucgugggccugcugcugaccaccgccauggccgccgccgugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacgugggcugcugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8598 - RNA, 2338 nt, Artificial Sequence
  ZIKV prME variant mRNA Design 3 opt
gggagaaagcuuaccaugagaggccugagcagcagaaagagaagaagccacgacgugcugaccgugcaguuccugauccugggcaugcugcugaugaccggcggcgugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacgugggcugcugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8599 - RNA, 2338 nt, Artificial Sequence
  ZIKV prME variant mRNA Design 3 opt
gggagaaagcuuaccaugagaggccugagcagcagaaagagaagaagccacgacgugcugaccgugcaguuccugauccugggcaugcugcugaugaccggcgccgugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacgugggcugcugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8600 - RNA, 2338 nt, Artificial Sequence
  ZIKV prME variant mRNA Design 3 opt
gggagaaagcuuaccaugagaaucaucaacgccagaaaggagaagaagagaagaggcgccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8601 - RNA, 2335 nt, Artificial Sequence
  ZIKV prME variant mRNA Design 3 opt
gggagaaagcuuaccaugaucaucaacgccagaaaggagaagaagagaagaggcgccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8602 - RNA, 2332 nt, Artificial Sequence
  ZIKV prME variant mRNA Design 3 opt
gggagaaagcuuaccaugaucaacgccagaaaggagaagaagagaagaggcgccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8603 - RNA, 2329 nt, Artificial Sequence
  ZIKV prME variant mRNA Design 3 opt
gggagaaagcuuaccaugaacgccagaaaggagaagaagagaagaggcgccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8604 - RNA, 2326 nt, Artificial Sequence
  ZIKV prME variant mRNA Design 3 opt
gggagaaagcuuaccauggccagaaaggagaagaagagaagaggcgccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8605 - RNA, 2323 nt, Artificial Sequence
  ZIKV prME variant mRNA Design 3 opt
gggagaaagcuuaccaugagaaaggagaagaagagaagaggcgccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8606 - RNA, 2320 nt, Artificial Sequence
  ZIKV prME variant mRNA Design 3 opt
gggagaaagcuuaccaugaaggagaagaagagaagaggcgccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8607 - RNA, 2317 nt, Artificial Sequence
  ZIKV prME variant mRNA Design 3 opt
gggagaaagcuuaccauggagaagaagagaagaggcgccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8608 - RNA, 2314 nt, Artificial Sequence
  ZIKV prME variant mRNA Design 3 opt
gggagaaagcuuaccaugaagaagagaagaggcgccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8609 - RNA, 2311 nt, Artificial Sequence
  ZIKV prME variant mRNA Design 3 opt
gggagaaagcuuaccaugaagagaagaggcgccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8610 - RNA, 2308 nt, Artificial Sequence
  ZIKV prME variant mRNA Design 3 opt
gggagaaagcuuaccaugagaagaggcgccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8611 - RNA, 2305 nt, Artificial Sequence
  ZIKV prME variant mRNA Design 3 opt
gggagaaagcuuaccaugagaggcgccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8612 - RNA, 2302 nt, Artificial Sequence
  ZIKV prME variant mRNA Design 3 opt
gggagaaagcuuaccaugggcgccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8613 - RNA, 2299 nt, Artificial Sequence
  ZIKV prME variant mRNA Design 3 opt
gggagaaagcuuaccauggccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8614 - RNA, 2296 nt, Artificial Sequence
  ZIKV prME variant mRNA Design 3 opt
gggagaaagcuuaccauggacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8615 - RNA, 2293 nt, Artificial Sequence
  ZIKV prME variant mRNA Design 3 opt
gggagaaagcuuaccaugaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8616 - RNA, 2293 nt, Artificial Sequence
  ZIKV prME variant mRNA Design 3 opt
gggagaaagcuuaccaugaccagcgugggcaucgugggccugcugcugaccaccgccauggccgccgccgugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8617 - RNA, 2305 nt, Artificial Sequence
  ZIKV prME variant mRNA Design 3 opt
gggagaaagcuuaccaugagaggcgccgacaccagcgugggcaucgugggccugcugcugaccaccgccauggccgccgccgugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8618 - RNA, 2329 nt, Artificial Sequence
  ZIKV prME variant mRNA Design 3 opt
gggagaaagcuuaccaugagaggccugagcagcagaaagagaagaagccacgacgugcugaccgugcaguuccugauccugggcaugcugcugaugaccggcggcgugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8619 - RNA, 2329 nt, Artificial Sequence
  ZIKV prME variant mRNA Design 3 opt
gggagaaagcuuaccaugagaggccugagcagcagaaagagaagaagccacgacgugcugaccgugcaguuccugauccugggcaugcugcugaugaccggcgccgugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8620 - RNA, 2335 nt, Artificial Sequence
  ZIKV prME variant mRNA Design 3 opt
gggagaaagcuuaccaugagaaucaucaacgccagaaaggagaagaagagaagaggcgccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8621 - RNA, 2329 nt, Artificial Sequence
  ZIKV prME variant mRNA Design 3 opt
gggagaaagcuuaccaugaucaacgccagaaaggagaagaagagaagaggcgccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8622 - RNA, 2332 nt, Artificial Sequence
  ZIKV prME variant mRNA Design 3 opt
gggagaaagcuuaccaugaucaucaacgccagaaaggagaagaagagaagaggcgccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8623 - RNA, 2326 nt, Artificial Sequence
  ZIKV prME variant mRNA Design 3 opt
gggagaaagcuuaccaugaacgccagaaaggagaagaagagaagaggcgccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8624 - RNA, 2323 nt, Artificial Sequence
  ZIKV prME variant mRNA Design 3 opt
gggagaaagcuuaccauggccagaaaggagaagaagagaagaggcgccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8625 - RNA, 2320 nt, Artificial Sequence
  ZIKV prME variant mRNA Design 3 opt
gggagaaagcuuaccaugagaaaggagaagaagagaagaggcgccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8626 - RNA, 2317 nt, Artificial Sequence
  ZIKV prME variant mRNA Design 3 opt
gggagaaagcuuaccaugaaggagaagaagagaagaggcgccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8627 - RNA, 2314 nt, Artificial Sequence
  ZIKV prME variant mRNA Design 3 opt
gggagaaagcuuaccauggagaagaagagaagaggcgccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8628 - RNA, 2311 nt, Artificial Sequence
  ZIKV prME variant mRNA Design 3 opt
gggagaaagcuuaccaugaagaagagaagaggcgccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8629 - RNA, 2308 nt, Artificial Sequence
  ZIKV prME variant mRNA Design 3 opt
gggagaaagcuuaccaugaagagaagaggcgccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8630 - RNA, 2305 nt, Artificial Sequence
  ZIKV prME variant mRNA Design 3 opt
gggagaaagcuuaccaugagaagaggcgccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8631 - RNA, 2302 nt, Artificial Sequence
  ZIKV prME variant mRNA Design 3 opt
gggagaaagcuuaccaugagaggcgccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8632 - RNA, 2299 nt, Artificial Sequence
  ZIKV prME variant mRNA Design 3 opt
gggagaaagcuuaccaugggcgccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8633 - RNA, 2296 nt, Artificial Sequence
  ZIKV prME variant mRNA Design 3 opt
gggagaaagcuuaccauggccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8634 - RNA, 2293 nt, Artificial Sequence
  ZIKV prME variant mRNA Design 3 opt
gggagaaagcuuaccauggacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8635 - RNA, 2290 nt, Artificial Sequence; identical to SEQ ID NO: 8541
  ZIKV (strain ZikaSPH2015) Polyprotein(108-794) mRNA Design 3 opt

SEQ ID NO: 8636 - RNA, 2290 nt, Artificial Sequence
  ZIKV prME variant mRNA Design 3 opt
gggagaaagcuuaccaugaccagcgugggcaucgugggccugcugcugaccaccgccauggccgccgccgugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8637 - RNA, 2302 nt, Artificial Sequence
  ZIKV prME variant mRNA Design 3 opt
gggagaaagcuuaccaugagaggcgccgacaccagcgugggcaucgugggccugcugcugaccaccgccauggccgccgccgugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8638 - RNA, 2326 nt, Artificial Sequence
  ZIKV prME variant mRNA Design 3 opt
gggagaaagcuuaccaugagaggccugagcagcagaaagagaagaagccacgacgugcugaccgugcaguuccugauccugggcaugcugcugaugaccggcggcgugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8639 - RNA, 2326 nt, Artificial Sequence
  ZIKV prME variant mRNA Design 3 opt
gggagaaagcuuaccaugagaggccugagcagcagaaagagaagaagccacgacgugcugaccgugcaguuccugauccugggcaugcugcugaugaccggcgccgugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8640 - RNA, 2365 nt, Artificial Sequence; identical to SEQ ID NO: 8537
  KU321639.1 prME-long mRNA Design 3 opt

SEQ ID NO: 8641 - RNA, 2365 nt, Artificial Sequence; identical to SEQ ID NO: 8538
  KU312312.1 prME-long mRNA Design 3 opt

SEQ ID NO: 8642 - RNA, 2353 nt, Artificial Sequence; identical to SEQ ID NO: 8539
  AY632535.2 prME-long mRNA Design 3 opt

SEQ ID NO: 8643 - RNA, 2365 nt, Artificial Sequence; identical to SEQ ID NO: 8540
  KU527068.1 prME-long mRNA Design 3 opt

SEQ ID NO: 8644 - RNA, 2365 nt, Artificial Sequence
  KU720415.1 prME-long mRNA Design 3 opt
gggagaaagcuuaccaugagaaucaucaacgccagaaaggagagaaagagaagaggcgccgacaccagcaucggcaucaucggccugcugcugaccaccgccauggccgccgagaucaccagaagaggcagcgccuacuacauguaccuggacagaagcgacgccggcaaggccaucagcuucgccaccacccugggcgugaacaagugccacgugcagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucaagguggagaacuggaucuucagaaaccccggcuucgcccugguggccguggccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucaccugcagcaagaagaugaccggcaagagcauccagcccgagaaccuggaguacagaaucaugcugagcgugcacggcagccagcacagcggcaugaucgugaacgacaccggcuacgagaccgacgagaacagagccaagguggaggugacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcaagcuguucagcggccaccugaagugcagacugaagauggacaagcugagacugaagggcgugagcuacagccugugcaccgccgccuucaccuucaccaaggugcccgccgagacccugcacggcaccgugaccguggaggugcaguacgccggcaccgacggccccugcaagauccccgugcagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgacaagaagaucacccaccacuggcacagaagcggcagcaccaucggcaaggccuucgaggccaccgugagaggcgccaagagaauggccgugcugggcgacaccgccugggacuucggcagcgugggcggcguguucaacagccugggcaagggcauccaccagaucuucggcgccgccuucaagagccuguucggcggcaugagcugguucagccagauccugaucggcacccugcugguguggcugggccugaacaccaagaacggcagcaucagccugaccugccuggcccugggcggcgugaugaucuuccugagcaccgccgugagcgccgacgugggcugcagcguggacuucagcaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8645 - RNA, 2347 nt, Artificial Sequence
  DQ859059.1 prME-long mRNA Design 3 opt
gggagaaagcuuaccaugagaaucaucaacgccagaaaggagagaaagagaagaggcgccgacaccagcaucggcaucgugggccugcugcugaccaccgccauggccgccgagaucaccagaagaggcagcgccuacuacauguaccuggacagaagcgacgccggcaaggccaucagcuucgccaccacccugggcgugaacaagugccacgugcagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucaagguggagaacuggaucuucagaaaccccggcuucacccugguggccguggccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucaccugcagcaagaagaugaccggcaagagcauccagcccgagaaccuggaguacagaaucaugcugagcgugcacggcagccagcacagcggcaugaucgugaacgacgagaacagagccaagguggaggugacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacuguucagcggccaccugaagugcagacugaagauggacaagcugagacugaagggcgugagcuacagccugugcaccgccgccuucaccuucaccaaggugcccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgacaagaagaucacccaccacuggcacagaagcggcagcaccaucggcaaggccuucgaggccaccgugagaggcgccaagagaauggccgugcugggcgacaccgccugggacuucggcagcgugggcggcguguucaacagccugggcaagggcauccaccagaucuucggcgccgccuucaagagccuguucggcggcaugagcugguucagccagauccugaucggcacccugcugguguggcugggccugaacaccaagaacggcagcaucagccugaccugccuggcccugggcggcgugaugaucuuccugagcaccgccgugagcgccgacgugggcugcagcguggacuucagcaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8646 - RNA, 2365 nt, Artificial Sequence
  KX377335.1 prME-long mRNA Design 3 opt
gggagaaagcuuaccaugagaaucaucaacgccagaaaggagagaaagagaagaggcgccgacaccagcaucggcaucaucggccugcugcugaccaccgccauggccgccgagaucaccagaagaggcagcgccuacuacauguaccuggacagaagcgacgccggcaaggccaucagcuucgccaccacccugggcgugaacaagugccacgugcagaucauggaccugggccacaugugcgacgccaccaugagcuacgagugccccaugcuggacgagggcguggagcccgacgacguggacugcuggugcaacaccaccagcaccugggugguguacggcaccugccacagaaagaagggcgaggccagaagaagcagaagagccgugacccugcccagccacagcaccagaaagcugcagaccagaagccagaccuggcuggagagcagagaguacaccaagcaccugaucaagguggagaacuggaucuucagaaaccccggcuucgcccugguggccguggccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucaccugcagcaagaagaugaccggcaagagcauccagcccgagaaccuggaguacagaaucaugcugagcgugcacggcagccagcacagcggcaugaucgugaacgacaccggcuacgagaccgacgagaacagagccaagguggaggugacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcaagcuguucagcggccaccugaagugcagacugaagauggacaagcugagacugaagggcgugagcuacagccugugcaccgccgccuucaccuucaccaaggugcccgccgagacccugcacggcaccgugaccguggaggugcaguacgccggcaccgacggccccugcaagauccccgugcagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgacaagaagaucacccaccacuggcacagaagcggcagcaccaucggcaaggccuucgaggccaccgugagaggcgccaagagaauggccgugcugggcgacaccgccugggacuucggcagcgugggcggcguguucaacagccugggcaagggcauccaccagaucuucggcgccgccuucaagagccuguucggcggcaugagcugguucagccagauccugaucggcacccugcugguguggcugggccugaacaccaagaacggcagcaucagccugaccugccuggcccugggcggcgugaugaucuuccugagcaccgccgugagcgccgacgugggcugcagcguggacuucagcaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8647 - RNA, 2365 nt, Artificial Sequence
  LC002520.1 prME-long mRNA Design 3 opt
gggagaaagcuuaccaugagaaucaucaacgccagaaaggagagaaagagaagaggcgccgacaccagcaucggcaucaucggccugcugcugaccaccgccauggccgccgagaucaccagaagaggcagcgccuacuacauguaccuggacagaagcgacgccggcaaggccaucagcuucgccaccacccugggcgugaacaagugccacgugcagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucaagguggagaacuggaucuucagaaaccccggcuucgcccugguggccguggccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucaccugcagcaagaagaugaccggcaagagcauccagcccgagaaccuggaguacagaaucaugcugagcgugcacggcagccagcacagcggcaugaccgugaacgacaucggcuacgagaccgacgagaacagagccaagguggaggugacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcaagcuguucagcggccaccugaagugcagacugaagauggacaagcugagacugaagggcgugagcuacagccugugcaccgccgccuucaccuucaccaaggugcccgccgagacccugcacggcaccgugaccguggaggugcaguacgccggcaccgacggccccugcaagauccccgugcagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgacaagaagaucacccaccacuggcacagaagcggcagcaccaucggcaaggccuucgaggccaccgugagaggcgccaagagaauggccgugcugggcgacaccgccugggacuucggcagcgugggcggcguguucaacagccugggcaagggcauccaccagaucuucggcgccgccuucaagagccuguucggcggcaugagcugguucagccagauccugaucggcacccugcugguguggcugggccugaacaccaagaacggcagcaucagccugaccugccuggcccugggcggcgugaugaucuuccugagcaccgccgugagcgccgacgugggcugcagcguggacuucagcaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8648 - RNA, 2353 nt, Artificial Sequence
  KU963573.2 prME-long mRNA Design 3 opt
gggagaaagcuuaccaugagaaucaucaacgccagaaaggagagaaagagaagaggcgccgacaccagcaucggcaucaucggccugcugcugaccaccgccauggccgccgagaucaccagaagaggcagcgccuacuacauguaccuggacagaagcgacgccggcaaggccaucagcuucgccaccacccugggcgugaacaagugccacgugcagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucaagguggagaacuggaucuucagaaaccccggcuucgcccugguggccguggccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucaccugcagcaagaagaugaccggcaagagcauccagcccgagaaccuggaguacagaaucaugcugagcgugcacggcagccagcacagcggcaugaucggcuacgagaccgacgagaacagagccaagguggaggugacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcaagcuguucagcggccaccugaagugcagacugaagauggacaagcugagacugaagggcgugagcuacagccugugcaccgccgccuucaccuucaccaaggugcccgccgagacccugcacggcaccgugaccguggaggugcaguacgccggcaccgacggccccugcaagauccccgugcagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgacaagaagaucacccaccacuggcacagaagcggcagcaccaucggcaaggccuucgaggccaccgugagaggcgccaagagaauggccgugcugggcgacaccgccugggacuucggcagcgugggcggcguguucaacagccugggcaagggcauccaccagaucuucggcgccgccuucaagagccuguucggcggcaugagcugguucagccagauccugaucggcacccugcugguguggcugggccugaacaccaagaacggcagcaucagccugaccugccuggcccugggcggcgugaugaucuuccugagcaccgccgugagcgccgacgugggcugcagcguggacuucagcaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8649 - RNA, 2365 nt, Artificial Sequence
  KX694534.2 prME-long mRNA Design 3 opt
gggagaaagcuuaccaugagaaucaucaacgccagaaaggagaagaagagaagaggcgccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcagaggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacgugggcugcagcguggacuucagcaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8650 - RNA, 2365 nt, Artificial Sequence
  KX447520.1 prME-long mRNA Design 3 opt
gggagaaagcuuaccaugagaaucaucaacgccagaaaggagaagaagagaagaggcgccgacgccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacgugggcugcagcguggacuucagcaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8651 - RNA, 2365 nt, Artificial Sequence
  KX369547.1 prME-long mRNA Design 3 opt
gggagaaagcuuaccaugagaaucaucaacgccagaaaggagaagaagagaagaggcgccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggccuggcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacgugggcugcagcguggacuucagcaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8652 - RNA, 2365 nt, Artificial Sequence
  KX447515.1 prME-long mRNA Design 3 opt
gggagaaagcuuaccaugagaaucaucaacgccagaaaggagaagaagagaagaggcgccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacugguacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacgugggcugcagcguggacuucagcaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8653 - RNA, 2365 nt, Artificial Sequence
  KU501217.1 prME-long mRNA Design 3 opt
gggagaaagcuuaccaugagaaucaucaacgccagaaaggagaagaagagaagaggcgccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgagaucagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacgugggcugcagcguggacuucagcaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8654 - RNA, 2365 nt, Artificial Sequence
  KU312314.1 prME-long mRNA Design 3 opt
gggagaaagcuuaccaugagaaucaucaacgccagaaaggagaagaagagaagaggcgccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcuggcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacgugggcugcagcguggacuucagcaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8655 - RNA, 2365 nt, Artificial Sequence
  KX446950.2 prME-long mRNA Design 3 opt
gggagaaagcuuaccaugagaaucaucaacgccagaaaggagaagaagagaagaggcgccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccacccuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacgugggcugcagcguggacuucagcaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8656 - RNA, 2365 nt, Artificial Sequence
  KY003157.1 prME-long mRNA Design 3 opt
gggagaaagcuuaccaugagaaucaucaacgccagaaaggagaagaagagaagaggcgccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccguggugagcgccgacgugggcugcagcguggacuucagcaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8657 - RNA, 2365 nt, Artificial Sequence
  KX811222.1 prME-long mRNA Design 3 opt
gggagaaagcuuaccaugagaaucaucaacgccagaaaggagaagaagagaagaggcgccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcgccugggugguguacggcaccugccaccacaagaagggcgaggccagaagaagcagaagagccgugacccugcccagccacagcaccagaaagcugcagaccagaccccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacgugggcugcagcguggacuucagcaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8658 - RNA, 2365 nt, Artificial Sequence
  KX447516.1 prME-long mRNA Design 3 opt
gggagaaagcuuaccaugagaaucaucaacgccagaaaggagaagaagagaagaggcgccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagcaagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacgugggcugcagcguggacuucagcaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8659 - RNA, 2365 nt, Artificial Sequence
  KX520666.1 prME-long mRNA Design 3 opt
gggagaaagcuuaccaugagaaucaucaacgccagaaaggagaagaagagaagaggcgccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagacagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacgugggcugcagcguggacuucagcaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8660 - RNA, 2365 nt, Artificial Sequence
  KU729218.1 prME-long mRNA Design 3 opt
gggagaaagcuuaccaugagaaucaucaacgccagaaaggagaagaagagaagaagcgccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacacccagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacgugggcugcagcguggacuucagcaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8661 - RNA, 2365 nt, Artificial Sequence
  KU761561.1 prME-long mRNA Design 3 opt
gggagaaagcuuaccaugagaaucaucaacgccagaaaggagaagaagagaagaggcgccgacaccaacgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccagaagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacgugggcugcagcguggacuucagcaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8662 - RNA, 2365 nt, Artificial Sequence
  KY317938.1 prME-long mRNA Design 3 opt
gggagaaagcuuaccaugagaaucaucaacgccagaaaggagaagaagagaagaggcgccgagaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacgugggcugcagcguggacuucagcaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8663 - RNA, 2365 nt, Artificial Sequence
  KY075939.1 prME-long mRNA Design 3 opt
gggagaaagcuuaccaugagaaucaucaacgccagaaaggagaagaagagaagaggcgccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagccugagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacgugggcugcagcguggacuucagcaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8664 - RNA, 2365 nt, Artificial Sequence
  KX806557.2 prME-long mRNA Design 3 opt
gggagaaagcuuaccaugagaaucaucaacgccagaaaggagaagaagagaagaggcgccgacaccaacgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggauguucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacgugggcugcagcguggacuucagcaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8665 - RNA, 2365 nt, Artificial Sequence
  KU870645.1 prME-long mRNA Design 3 opt
gggagaaagcuuaccaugagaaucaucaacgccagaaaggagaagaagagaagaggcgccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggauccugagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcaucggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacgugggcugcagcguggacuucagcaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8666 - RNA, 2365 nt, Artificial Sequence
  KU729217.2 prME-long mRNA Design 3 opt
gggagaaagcuuaccaugagaaucaucaacgccagaaaggagaagaagagaagaggcgccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugagcaccaccgugagcaacauggccgaggugagaagcuacugcuacgaggccaccaucagcgacaucgccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgccguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacgugggcugcagcguggacuucagcaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8667 - RNA, 2365 nt, Artificial Sequence
  KU497555.1 prME-long mRNA Design 3 opt
gggagaaagcuuaccaugagaaucaucaacgccagaaaggagaagaagagaagaggcgccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcacccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacgugggcugcagcguggacuucagcaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8668 - RNA, 2365 nt, Artificial Sequence
  KX087101.3 prME-long mRNA Design 3 opt
gggagaaagcuuaccaugagaaucaucaacgccagaaaggagaagaagagaagaggcgccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggagcugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacgugggcugcagcguggacuucagcaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8669 - RNA, 2365 nt, Artificial Sequence
  KY075932.1 prME-long mRNA Design 3 opt
gggagaaagcuuaccaugagaaucaucaacgccagaaaggagaagaagagaagaggcgccgagaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaaucgagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacgugggcugcagcguggacuucagcaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8670 - RNA, 2365 nt, Artificial Sequence
  KY014317.1 prME-long mRNA Design 3 opt
gggagaaagcuuaccaugagaaucaucaacgccagaaaggagaagaagagaagaggcgccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaucgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacgugggcugcagcguggacuucagcaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8671 - RNA, 2365 nt, Artificial Sequence
  KU758876.1 prME-long mRNA Design 3 opt
gggagaaagcuuaccaugagaaucaucaacgccagaaaggagaagaagagaagaggcgccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgugaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagcuucaugugccuggcccugggcggcgugcugaucuuccugagcaccgccgugagcgccgacgugggcugcagcguggacuucagcaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8672 - RNA, 2365 nt, Artificial Sequence
  KU758874.1 prME-long mRNA Design 3 opt
gggagaaagcuuaccaugagaaucaucaacgccagaaaggagaagaagagaagaggcgccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcaagcugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacgugggcugcagcguggacuucagcaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8673 - RNA, 2365 nt, Artificial Sequence
  KY014314.1 prME-long mRNA Design 3 opt
gggagaaagcuuaccaugagaaucaucaacgccagaaaggagaagaagagaagaggcgccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggaggcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacgugggcugcagcguggacuucagcaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8674 - RNA, 2365 nt, Artificial Sequence
  KU926310.1 prME-long mRNA Design 3 opt
gggagaaagcuuaccaugagaaucaucaacgccagaaaggagaagaagagaagaggcgccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcgccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacgugggcugcagcguggacuucagcaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8675 - RNA, 2365 nt, Artificial Sequence
  KU761560.1 prME-long mRNA Design 3 opt
gggagaaagcuuaccaugagaaucaucaacgccggcaaggagaagaagagaagaggcgccgacaccaacgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccagaagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacgugggcugcagcguggacuucagcaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8676 - RNA, 2365 nt, Artificial Sequence
  KY317939.1 prME-long mRNA Design 3 opt
gggagaaagcuuaccaugagaaucaucaacgccagaaaggagaagaagagaagaggcgccgagaccagcgugggcaucgugggccugcugcugaccaccgccauggccgccgaggugaccagaagaggcagcgccuacuacauguaccuggacagaaaggacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacgugggcugcagcguggacuucagcaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8677 - RNA, 2365 nt, Artificial Sequence
  KY075937.1 prME-long mRNA Design 3 opt
gggagaaagcuuaccaugagaaucaucaacgccagaaaggagaagaagagaagaggcgccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggugagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacgugggcugcagcguggacuucagcaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8678 - RNA, 2365 nt, Artificial Sequence
  LC191864.1 prME-long mRNA Design 3 opt
gggagaaagcuuaccaugagaaucaucaacgccagaaaggagaagaagagaagaggcgccgacaccaacgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaugaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacgugggcugcagcguggacuucagcaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8679 - RNA, 2365 nt, Artificial Sequence
  KX447517.1 prME-long mRNA Design 3 opt
gggagaaagcuuaccaugagaaucaucaacgccagaaaggagaagaagagaagaggcgccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccgcccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagacccugaucggcacccugcugauguggcugggccugaacaccaagaacggcagcaucagccugaugugccuggcccugggcggcgugcugaucuuccugagcaccgccgugagcgccgacgugggcugcagcguggacuucagcaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8680 - RNA, 2365 nt, Artificial Sequence
  KU922923.1 prME-long mRNA Design 3 opt
gggagaaagcuuaccaugagaaucaucaacgccagaaaggagaagaagagaagaggcgccgagaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccuggccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacgugggcugcagcguggacuucagcaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8681 - RNA, 2365 nt, Artificial Sequence
  KY003156.1 prME-long mRNA Design 3 opt
gggagaaagcuuaccaugagaaucaucaacgccagaaaggagaagaagagaagaggcgccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcaucagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcauccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacgugggcugcagcguggacuucagcaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8682 - RNA, 2365 nt, Artificial Sequence
  KU312313.1 prME-long mRNA Design 3 opt
gggagaaagcuuaccaugagaaucaucaacgccagaaaggagaagaagagaagaggcgccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaccugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaucagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacgccaagaacggcagcaucagccugaugugccuggcccugggcggcgugcugaucuuccugagcaccgccgugagcgccgacgugggcugcagcguggacuucagcaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8683 - RNA, 2365 nt, Artificial Sequence
  KY075935.1 prME-long mRNA Design 3 opt
gggagaaagcuuaccaugagaaucaucaacgccagaaaggagaagaagagaagaggcgccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggcccagagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacgugggcugcagcguggacuucagcaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8684 - RNA, 2365 nt, Artificial Sequence
  KY014320.1 prME-long mRNA Design 3 opt
gggagaaagcuuaccaugagaaucaucaacgccagaaaggagaagaagagaagaggcgccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcaggccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacgugggcugcagcguggacuucagcaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8685 - RNA, 2365 nt, Artificial Sequence
  KX827309.1 prME-long mRNA Design 3 opt
gggagaaagcuuaccaugagaaucaucaacgccagaaaggagaagaagagaagaggcgccgacaccagcgugggcaucgugggccugcugcugaccaccgccauggccgccgaggugaccagaagaggcagcgccuacuacauguaccuggacagaagcgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacgugggcugcagcguggacuucagcaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8686 - RNA, 2365 nt, Artificial Sequence
  KU681081.3 prME-long mRNA Design 3 opt
gggagaaagcuuaccaugagaaucaucaacgccagaaaggagaagaagagaagaggcaccgacaccagcgugggcaucgugggccugcugcugaccaccgccauggccgccgaggugaccagaagaggcagcgccuacuacauguaccuggacagaagcgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacaccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagggcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgugcugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacgugggcugcagcguggacuucagcaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8687 - RNA, 2365 nt, Artificial Sequence
  KU744693.1 prME-long mRNA Design 3 opt
gggagaaagcuuaccaugagaaucaucaacgccagaaaggagaagaagagaagaggcgccgacaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgccauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugcuggugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggcccacaaggagugguuccacgacaucccccugcccuggcacgccggcgccgccaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagaccguggacggcaccgugaccguggagggccaguacggcggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucaucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcggcggcgugggcugcagcguggacuucagcaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8688 - RNA, 2365 nt, Artificial Sequence
  KY328290.1 prME-long mRNA Design 3 opt
gggagaaagcuuaccaugagaaucaucaacgccagaaaggagaagaagagaagaggcaccgacaccagcgugggcaucgugggccugcugcugaccaccgccauggccgccgaggugaccagaagaggcagcgccuacuacauguaccuggacagaagcgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucagcaagauccccgccgagacccugcacggcaccgugaccgaggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacgugggcugcagcguggacuucagcaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8689 - RNA, 2365 nt, Artificial Sequence
  KX694532.2 prME-long mRNA Design 3 opt
gggagaaagcuuaccaugagaaucaucaacgccagaaaggagaagaagagaagaggcaccgacaccagcgugggcaucgugggccugcugcugaccaccgccauggccgccgaggugaccagaagaggcagcgccuacuacauguaccuggacagaagcgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccgacgugggcugcagcguggacuucagcaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8690 - RNA, 2365 nt, Artificial Sequence
  KU955593.1 prME-long mRNA Design 3 opt
gggagaaagcuuaccaugagaaucaucaacgccagaaaggagaagaagagaagaggcaccgacaccagcgugggcaucgugggccugcugcugaccaccgccauggccguggaggugaccagaagaggcaacgccuacuacauguaccuggacagaagcgacgccggcgaggccaucagcuuccccaccaccaugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugguguggcugggccugaacaccaagaacggcagcaucagccugaugugccuggcccugggcggcgugcugaucuuccugagcaccgccgugagcgccgacgugggcugcagcguggacuucagcaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8691 - RNA, 2365 nt, Artificial Sequence
  KY272987.1 prME-long mRNA Design 3 opt
gggagaaagcuuaccaugagaaucaucaacgccagaaaggagaagaagagaagaggcaccgacaccagcgugggcaucgugggccugcugcugaccaccgccauggccgccgaggugaccagaagaggcagcgccuacuacauguaccuggacagaagcgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccuggugugccuggcccugggcggcgugcugaucuuccugagcaccgccgugagcgccgacgugggcugcagcguggacuucagcaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8692 - RNA, 2365 nt, Artificial Sequence
  EU545988.1 prME-long mRNA Design 3 opt
gggagaaagcuuaccaugagaaucaucaacgccagaaaggagaagaagagaagaggcaccgacaccagcgugggcaucgugggccugcugcugaccaccgccauggccguggaggugaccagaagaggcagcgccuacuacauguaccuggacagaagcgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccgccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugguguggcugggccugaacaccaagaacggcagcaucagccugaccugccuggcccugggcggcgugcugaucuuccugagcaccgccgugagcgccgacgugggcugcagcguggacuucagcaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8693 - RNA, 2365 nt, Artificial Sequence
  KU681082.3 prME-long mRNA Design 3 opt
gggagaaagcuuaccaugagaaucaucaacgccagaaaggagaagaagagaagaggcgccgacaccagcgugggcaucgugggccugcugcugaccaccgccauggccguggaggugaccagaagaggcagcgccuacuacauguaccuggacagaagcgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgugaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugguguggcugggccugaacaccaagaacggcagcaucagccugaccugccuggcccugggcggcgugcugaucuuccugagcaccgccgugagcgccgacgugggcugcagcguggacuucagcaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8694 - RNA, 2365 nt, Artificial Sequence
  KX601167.1 prME-long mRNA Design 3 opt
gggagaaagcuuaccaugagaaucaucaacgccagaaaggagaagaagagaagaggcgccgacaccagcgugggcaucgugggccugcugcugaccaccgccauggccguggaggugaccagaagaggcagcgccuacuacauguaccuggacagaagcgacgccggcgaggccaucagcuuccccaccacccugggcgugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgacaagaagaucacccaccacugguacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugguguggcugggccugaacaccaagaacggcagcaucagccugaccugccuggcccugggcggcgugcugaucuuccugagcaccgccgugagcgccgacgugggcugcagcguggacuucagcaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8695 - RNA, 2365 nt, Artificial Sequence
  KX694533.2 prME-long mRNA Design 3 opt
gggagaaagcuuaccaugagaaucaucaacgccagaaaggagaagaagagaagaggcgccgacaccagcgugggcaucgugggccugcugcugaccaccgccauggccguggaggugaccagaagaggcagcgccuacuacauguaccuggacagaagcgacgccggcaaggccaucagcuuccccaccacccugggcgugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaucggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgacaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugguguggcugggccugaacaccaagaacggcagcaucagccugaccugccuggcccugggcggcgugcugaucuuccugagcaccgccgugagcgccgacgugggcugcagcguggacuucagcaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8696 - RNA, 2365 nt, Artificial Sequence
  KY288905.1 prME-long mRNA Design 3 opt
gggagaaagcuuaccaugagaaucaucaacgccagaaaggagagaaagagaagaggcgccgacaccagcaucggcaucgugggccugcugcugaccaccgccauggccgccgagaucaccagaagaggcagcgccuacuacauguaccuggacagaagcgacgccggcaaggccaucagcuucgccaccacccugggcgugaacaagugccacgugcagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucaagguggagaacuggaucuucagaaaccccggcuucacccugguggccguggccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucaccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggaggugacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacuguucagcggccaccugaagugcagacugaagauggacaagcugagacugaagggcgugagcuacagccugugcaccgccgccuucaccuucaccaaggugcccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgacaagaagaucacccaccacuggcacagaagcggcagcaccaucggcaaggccuucgaggccaccgugagaggcgccaagagaauggccgugcugggcgacaccgccugggacuucggcagcgugggcggcguguucaacagccugggcaagggcauccaccagaucuucggcgccgccuucaagagccuguucggcggcaugagcugguucagccagauccugaucggcacccugcugguguggcugggccugaacaccaagaacggcagcaucagccugaccugccuggcccugggcggcgugaugaucuuccugagcaccgccgugagcgccgacgugggcugcagcguggacuucagcaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8697 - RNA, 2365 nt, Artificial Sequence
  KF268950.1 prME-long mRNA Design 3 opt
gggagaaagcuuaccaugagaaucaucaacgccagaaaggagagaaagagaagaggcgccgacaccagcaucggcaucaucggccugcugcugaccaccgccauggccgccgagaucaccagaagaggcagcgccuacuacauguaccuggacagaagcgacgccggcaaggccaucagcuucgccaccaaccugggcgugaacaagugccacgugcagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucaagguggagaacuggaucuucagaaaccccggcuucgcccuggccgccguggccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucaccugcagcaagaagaugaccggcaagagcauccagcccgagaaccuggaguacagaaucaugcugagcgugcacggcagccagcacagcggcaugaucgugaacgacaucggccacgagaccgacgagaacagagccaagguggaggugacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacuguucagcggccaccugaagugcagacugaagauggacaagcugagacugaagggcgugagcuacagccugugcaccgccgccuucaccuucaccaaggugcccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgacaagaagaucacccaccacuggcacagaagcggcagcaccaucggcaaggccuucgaggccaccgugagaggcgccaagagaauggccgugcugggcgacaccgccugggacuucggcagcgugggcggcguguucaacagccugggcaagggcgugcaccagaucuucggcgccgccuucaagagccuguucggcggcaugagcugguucagccagauccugaucggcacccugcugguguggcugggccugaacaccaagaacggcagcaucagccugaccugccuggcccugggcggcgugaugaucuuccugagcaccgccgugagcgccgacgugggcugcagcguggacuucagcaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8698 - RNA, 2365 nt, Artificial Sequence
  KF383121.1 prME-long mRNA Design 3 opt
gggagaaagcuuaccaugagaaucaucaacgccagaaaggagagaaagagaagaggcgccgacaccagcaucggcaucaucggccugcugcugaccaccgccauggccgccgagaucaccagaagaggcagcgccuacuacauguaccuggacagaagcgacgccggcaaggccaucagcuucgccaccacccugggcgugaacaagugccacgugcagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucaagguggagaacuggaucuucagaaaccccggcuucgcccugguggccguggccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucaccugcagcaagaagaugaccggcaagagcauccagcccgagaaccuggaguacagaaucaugcugagcgugcacggcagccagcacagcggcaugaucgugaacgacaucggccacgagaccgacgagaacagagccaagguggaggugacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacuguucagcggccaccugaagugcagacugaagauggacaagcugagacugaagggcgugagcuacagccugugcaccgccgccuucaccuucaccaaggugcccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgacaagaagaucacccaccacuggcacagaagcggcagcaccaucggcaaggccuucgaggccaccgugagaggcgccaagagaauggccgugcugggcgacaccgccugggacuucggcagcgugggcggcguguucaacagccugggcaagggcauccaccagaucuucggcgccgccuucaagagccuguucggcggcaugagcugguucagccagauccugaucggcacccugcugguguggcugggccugaacaccaagaacggcagcaucagccugaccugccuggcccugggcggcgugaugaucuuccugagcaccgccgugagcgccgacgugggcugcagcguggacuucagcaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8699 - RNA, 2347 nt, Artificial Sequence
  KF268949.1 prME-long mRNA Design 3 opt
gggagaaagcuuaccaugagaaucaucaacgccagaaaggagagaaagagaagaggcgccgacaccagcaucggcaucaucggccugcugcugaccaccgccauggccgccgagaucaccagaagaggcagcgccuacuacauguaccuggacagaagcgacgccggcaaggccaucagcuucgccaccaaccugggcgugaacaagugccacgugcagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucaagguggagaacuggaucuucagaaaccccggcuucgcccuggccgccguggccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucaccugcagcaagaagaugaccggcaagagcauccagcccgagaaccuggaguacagaaucaugcugagcgugcacggcagccagcacagcggcaugaucgugaacgacgagaacagagccaagguggaggugacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacuguucagcggccaccugaagugcagacugaagauggacaagcugagacugaagggcgugagcuacagccugugcaccgccgccuucaccuucaccaaggugcccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgacaagaagaucacccaccacuggcacagaagcggcagcaccaucggcaaggccuucgaggccaccgugagaggcgccaagagaauggccgugcugggcgacaccgccugggacuucggcagcgugggcggcguguucaacagccugggcaagggcauccaccagaucuucggcgccgccuucaagagccuguucggcggcaugagcugguucagccagauccugaucggcacccugcugguguggcugggccugaacaccaagaacggcagcaucagccugaccugccuggcccugggcggcgugaugaucuuccugagcaccgccgugagcgccgacgugggcugcagcguggacuucagcaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8700 - RNA, 2365 nt, Artificial Sequence
  KU955595.1 prME-long mRNA Design 3 opt
gggagaaagcuuaccaugagaaucaucaacgccagaaaggagagaaagagaagaggcgccgacaccagcaucggcaucgugggccugcugcugaccaccgccauggccgccgagaucaccagaagaggcagcgccuacuacauguaccuggacagaagcgacgccggcaaggccaucagcuucgccaccacccugggcgugaacaagugccacgugcagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucaagguggagaacuggaucuucagaaaccccggcuucgcccugguggccguggccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucaccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggaggugacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacuguucagcggccaccugaagugcagacugaagauggacaagcugagacugaagggcgugagcuacagccugugcaccgccgccuucaccuucaccaaggugcccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgacaagaagaucacccaccacuggcacagaagcggcagcaccaucggcaaggccuucgaggccaccgugagaggcgccaagagaauggccgugcugggcgacaccgccugggacuucggcagcgugggcggcguguucaacagccugggcaagggcauccaccagaucuucggcgccgccuucaagagccuguucggcggcaugagcugguucagccagauccugaucggcacccugcugguguggcugggccugaacaccaagaacggcagcaucagccugaccugccuggcccugggcggcgugaugaucuuccugagcaccgccgugagcgccgacgugggcugcagcguggacuucagcaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8701 - RNA, 2365 nt, Artificial Sequence
  KF383116.1 prME-long mRNA Design 3 opt
gggagaaagcuuaccaugagaaucaucaacgccagaaaggagagaaagagaagaggcgccgacaccagcaucggcaucgugggccugcugcugaccaccgccauggccgccgagaucaccagaagaggcagcgccuacuacauguaccuggacagaagcgacgccggcaaggccaucagcuucgccaccacccugggcgugaacaagugccacgugcagaucauggaccugggccacaugugcgacgccaccaugagcuacgagugccccaugcuggacgagggcguggagcccgacgacguggacugcuggugcaacaccaccagcaccugggugguguacggcaccugccagcacaagaagggcgaggccagaagaagcagaagagccgugacccugcccagccacagcaccagaaagcugcagaccagaagccagaccuggcuggagagcagagaguacaccaagcaccugaucaagguggagaacuggaucuucagaaaccccggcuucgcccugguggccguggccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucaccugcagcaagaagaugaccggcaagagcauccagcccgagaaccuggaguacagaaucaugcugagcgugcacggcagccagcacagcggcaugaucgugaacgacaucggccacgagaccgacgagaacagagccaagguggaggugacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacuguucagcggccaccugaagugcagacugaagauggacaagcugagacugaagggcgugagcuacagccugugcaccgccgugugcaccgccgccaaggugcccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgacaagaagaucacccaccacuggcacagaagcggcagcaccaucggcaaggccuucgaggccaccgugagaggcgccaagagaauggccgugcugggcgacaccgccugggacuucggcagcgugggcggcguguucaacagccugggcaagggcauccaccagaucuucggcgccgccuucaagagccuguucggcggcaugagcugguucagccagauccugaucggcacccugcugguguggcugggccugaacaccaagaacggcagcaucagccugaccugccuggcccugggcggcgugaugaucuuccugagcaccgccgugagcgccgacgugggcugcagcguggacuucagcaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8702 - RNA, 2347 nt, Artificial Sequence
  KU963574.2 prME-long mRNA Design 3 opt
gggagaaagcuuaccaugagaaucaucaacgccagaaaggagagaaagagaagaggcgccgacgccagcaucggcaucgugagccugcugcugaccaccgugauggccgccgagaucaccagaagaggcagcgccuacuacauguaccuggacagaagcgacgccggcaaggccaucagcuucgugaccacccugggcgugaacaagugccacgugcagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucaagguggagaacuggaucuucagaaaccccggcuucgcccugguggccguggccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucaccugcagcaagaagaugaccggcaagagcauccagcccgagaaccuggaguacagaaucaugcugagcgugcacggcagccagcacagcggcaugaucgugaacgacgagaacagagccaagguggaggugacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacagcggcgccgacaccgagaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaaggugcccgccgagacccugcacggcaccgugaccguggaggugcaguacgccggcagagacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgacaagaagaucacccaccacuggcacagaagcggcagcaucaucggcaaggccuucgaggccaccgugagaggcgccaagagaauggccgugcugggcgacaccgccugggacuucggcagcgugggcggcguguucaacagccugggcaagggcauccaccagaucuucggcgccgccuucaagagccuguucggcggcaugagcugguucagccagauccugaucggcacccugcugguguggcugggccugaacaccaagaacggcagcaucagccugaccugccuggcccugggcggcgugaugaucuuccugagcaccgccgugagcgccgacgugggcugcagcguggacuucagcaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8703 - RNA, 2347 nt, Artificial Sequence
  KX601166.1 prME-long mRNA Design 3 opt
gggagaaagcuuaccaugagaaucaucaacgccagaaaggagagaaagagaagaggcgccgacaccagcaucggcaucgugggccugcugcugaccaccgccauggccgccgagaucaccagaagaggcagcgccuacuacauguaccuggacagaagcgacgccggcaaggccaucagcuucgccaccacccugggcgugaacaagugccacgugcagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucaagguggagaacuggaucuucagaaaccccggcuucgcccugguggccguggccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucaccugcagcaagaagaugaccggcaagagcauccagcccgagaaccuggaguacagaaucaugcugagcgugcacggcagccagcacagcggcaugaucgugaacgacgagaacagagccaagguggaggugacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacuguucagcggccaccugaagugcagacugaagauggacaagcugagacugaagggcgugagcuacagccugugcaccgccgccuucaccuucaccaaggugcccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgacaagaagaucacccaccacuggcacagaagcggcagcaccaucggcaaggccuucgaggccaccgugagaggcgccaagagaauggccgugcugggcgacaccgccugggacuucggcagcgugggcggcguguucaacagccugggcaagggcauccaccagaucuucggcgccgccuucaagagccuguucggcggcaugagcugguucagccagauccugaucggcacccugcugguguggcugggccugaacaccaagaacggcagcaucagccugaccugccuggcccugggcggcgugaugaucuuccugagcaccgccgugagcgccgacgugggcugcagcguggacuucagcaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8704 - RNA, 2365 nt, Artificial Sequence
  KF383118.1 prME-long mRNA Design 3 opt
gggagaaagcuuaccaugagaaucaucaacgccagaaaggagagaaagagaagaggcgccgacaccagcaucggcaucaucggccugcugcugaccaccgccauggccgccgagaucaccagaagaggcagcgccuacuacauguaccuggacagaagcgacgccggcaaggccaucagcuucgccaccacccugggcgugaacaagugccacgugcagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgagaccagaagaagcagaagaagcgugagccugagauaccacuacaccagaaagcugcagaccagaagccagaccuggcuggagagcagagaguacaagaagcaccugaucaugguggagaacuggaucuucagaaaccccggcuucgccaucgugagcguggccaucaccuggcugaugggcagccugaccagccagaaggugaucuaccuggugaugaucgugcugaucgugcccgccuacagcaucagcugcaucggcgugagcaacagagaccugguggagggcaugagcggcggcaccuggguggacguggugcuggagcacggcggcugcgugaccgagauggcccaggacaagcccaccguggacaucgagcuggugaccaugaccgugagcaacauggccgaggugagaagcuacugcuacgaggccagccugagcgacauggccagcgccagcagaugccccacccagggcgagcccagccuggacaagcagagcgacacccagagcgugugcaagagaacccugggcgacagaggcuggggcaacggcugcggcaucuucggcaagggcagccuggugaccugcagcaaguucaccugcugcaagaagaugcccggcaagagcauccagcccgagaaccuggaguacagaaucaugcugcccgugcacggcagccagcacagcggcaugaucgugaacgacaucggccacgagaccgacgagaacagagccaagguggaggugacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacuguucagcggccaccugaagugcagacugaagauggacaagcugagacugaagggcgugagcuacagccugugcaccgccgccuucaccuucaccaaggugcccgccgagacccugcacggcaccgugaccguggaggugcagagcgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgacaagaagaucacccaccacuggcacagaagcggcagcaccaucggcaaggccuucgaggccaccgugagaggcgccaagagaauggccgugcugggcgacaccgccugggacuucggcagcgugggcggcguguucaacagccugggcaagggcauccaccagaucuucggcgccgccuucaagagccuguucggcggcaugagcugguucagccagauccugaucggcacccugcugguguggcugggccugaacaccaagaacggcagcaucagccugaccugccuggcccugggcggcgugaugaucuuccugagcaccgccgugagcgccgacgugggcugcagcguggacuucagcaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8705 - RNA, 2359 nt, Artificial Sequence
  KF383120.1 prME-long mRNA Design 3 opt
gggagaaagcuuaccaugagaaucaucaacgccagaaaggagagaaagagaagaggcgccgacaccagcaucggcaucaucggccugcugcugaccaccgccauggccgccgagaucaccagaagaggcagcgccuacuacauguaccuggacagaagcgacgccggcaaggccaucagcuucgccaccaccaugggcgugaacaagugccacgugcagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagacccagcagaagagccgugacccugcccagccacagcaccagaaagcugcagaccagaagccagaccuggcuggagagcagagaguacaccaagcaccugaucaagguggagaacuggauccugagaaaccccggcuucaccguggccgcccuggccauggccuggcugcugggcaacagcaccagccagagagugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucaccugcagcaagaagaugaccggcaagagcauccagcccgagaaccuggaguacagaaucaugcugagcgugcacggcagccagcacagcggcaugaucgugaacgacaucggccacgagaccgacgagaacagagccaagguggaggugacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacuguucagcggccaccugaagugcagaaucaagauggacaagcugagacugaagggcgugagcuacagccugugcaccgccgccuucaccuucagcaaggugcccgccgagacccugcacggcaccgugaccguggaggugcaguacgccggcagagacggccccugcaaggugcccgcccagauggccguggacaugcagacccugacccccgugggcagacugaucaccgccaaccccaucaucaccgagagcaccgagaacagcagaaugaugcuggagcuggacccccccuucggcgacagcuacaucgugaucggcgugggcgacaagaagaucacccaccacuggcacagaagcggcagcaccaucggcaaggccuucgaggccaccgugagaggcgccaagagaauggccgugcugggcgacaccgccugggacuucggcagcgugggcggcguguucaacagccugggcaagggcgugcaccagguguucggcgccgccuucaagagccuguucggcggcaugagcugguucagccagauccugaucggcacccugcugguguggcugggccugaacaccaagaacggcagcaucagccuggccugccuggcccugggcggcgccaugaucuuccugagcaccgccgugagcgccgacgugggcugcagcguggacuucugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8706 - RNA, 2290 nt, Artificial Sequence; identical to SEQ ID NO: 8541
  KU321639.1 prME-short mRNA Design 3 opt

SEQ ID NO: 8707 - RNA, 2290 nt, Artificial Sequence; identical to SEQ ID NO: 8542
  KU312312.1 prME-short mRNA Design 3 opt

SEQ ID NO: 8708 - RNA, 2278 nt, Artificial Sequence; identical to SEQ ID NO: 8543
  AY632535.2 prME-short mRNA Design 3 opt

SEQ ID NO: 8709 - RNA, 2290 nt, Artificial Sequence; identical to SEQ ID NO: 8544
  KU527068.1 prME-short mRNA Design 3 opt

SEQ ID NO: 8710 - RNA, 2290 nt, Artificial Sequence
  KX421193.1 prME-short mRNA Design 3 opt
gggagaaagcuuaccaugaccagcaucggcaucaucggccugcugcugaccaccgccauggccgccgagaucaccagaagaggcagcgccuacuacauguaccuggacagaagcgacgccggcaaggccaucagcuucgccaccacccugggcgugaacaagugccacgugcagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucaagguggagaacuggaucuucagaaaccccggcuucgcccugguggccguggccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucaccugcagcaagaagaugaccggcaagagcauccagcccgagaaccuggaguacagaaucaugcugagcgugcacggcagccagcacagcggcaugaucgugaacgacaccggcuacgagaccgacgagaacagagccaagguggaggugacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcaagcuguucagcggccaccugaagugcagacugaagauggacaagcugagacugaagggcgugagcuacagccugugcaccgccgccuucaccuucaccaaggugcccgccgagacccugcacggcaccgugaccguggaggugcaguacgccggcaccgacggccccugcaagauccccgugcagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgacaagaagaucacccaccacuggcacagaagcggcagcaccaucggcaaggccuucgaggccaccgugagaggcgccaagagaauggccgugcugggcgacaccgccugggacuucggcagcgugggcggcguguucaacagccugggcaagggcauccaccagaucuucggcgccgccuucaagagccuguucggcggcaugagcugguucagccagauccugaucggcacccugcugguguggcugggccugaacaccaagaacggcagcaucagccugaccugccuggcccugggcggcgugaugaucuuccugagcaccgccgugagcgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8711 - RNA, 2290 nt, Artificial Sequence
  KX377335.1 prME-short mRNA Design 3 opt
gggagaaagcuuaccaugaccagcaucggcaucaucggccugcugcugaccaccgccauggccgccgagaucaccagaagaggcagcgccuacuacauguaccuggacagaagcgacgccggcaaggccaucagcuucgccaccacccugggcgugaacaagugccacgugcagaucauggaccugggccacaugugcgacgccaccaugagcuacgagugccccaugcuggacgagggcguggagcccgacgacguggacugcuggugcaacaccaccagcaccugggugguguacggcaccugccacagaaagaagggcgaggccagaagaagcagaagagccgugacccugcccagccacagcaccagaaagcugcagaccagaagccagaccuggcuggagagcagagaguacaccaagcaccugaucaagguggagaacuggaucuucagaaaccccggcuucgcccugguggccguggccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucaccugcagcaagaagaugaccggcaagagcauccagcccgagaaccuggaguacagaaucaugcugagcgugcacggcagccagcacagcggcaugaucgugaacgacaccggcuacgagaccgacgagaacagagccaagguggaggugacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcaagcuguucagcggccaccugaagugcagacugaagauggacaagcugagacugaagggcgugagcuacagccugugcaccgccgccuucaccuucaccaaggugcccgccgagacccugcacggcaccgugaccguggaggugcaguacgccggcaccgacggccccugcaagauccccgugcagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgacaagaagaucacccaccacuggcacagaagcggcagcaccaucggcaaggccuucgaggccaccgugagaggcgccaagagaauggccgugcugggcgacaccgccugggacuucggcagcgugggcggcguguucaacagccugggcaagggcauccaccagaucuucggcgccgccuucaagagccuguucggcggcaugagcugguucagccagauccugaucggcacccugcugguguggcugggccugaacaccaagaacggcagcaucagccugaccugccuggcccugggcggcgugaugaucuuccugagcaccgccgugagcgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8712 - RNA, 2290 nt, Artificial Sequence
  LC002520.1 prME-short mRNA Design 3 opt
gggagaaagcuuaccaugaccagcaucggcaucaucggccugcugcugaccaccgccauggccgccgagaucaccagaagaggcagcgccuacuacauguaccuggacagaagcgacgccggcaaggccaucagcuucgccaccacccugggcgugaacaagugccacgugcagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucaagguggagaacuggaucuucagaaaccccggcuucgcccugguggccguggccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucaccugcagcaagaagaugaccggcaagagcauccagcccgagaaccuggaguacagaaucaugcugagcgugcacggcagccagcacagcggcaugaccgugaacgacaucggcuacgagaccgacgagaacagagccaagguggaggugacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcaagcuguucagcggccaccugaagugcagacugaagauggacaagcugagacugaagggcgugagcuacagccugugcaccgccgccuucaccuucaccaaggugcccgccgagacccugcacggcaccgugaccguggaggugcaguacgccggcaccgacggccccugcaagauccccgugcagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgacaagaagaucacccaccacuggcacagaagcggcagcaccaucggcaaggccuucgaggccaccgugagaggcgccaagagaauggccgugcugggcgacaccgccugggacuucggcagcgugggcggcguguucaacagccugggcaagggcauccaccagaucuucggcgccgccuucaagagccuguucggcggcaugagcugguucagccagauccugaucggcacccugcugguguggcugggccugaacaccaagaacggcagcaucagccugaccugccuggcccugggcggcgugaugaucuuccugagcaccgccgugagcgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8713 - RNA, 2272 nt, Artificial Sequence
  DQ859059.1 prME-short mRNA Design 3 opt
gggagaaagcuuaccaugaccagcaucggcaucgugggccugcugcugaccaccgccauggccgccgagaucaccagaagaggcagcgccuacuacauguaccuggacagaagcgacgccggcaaggccaucagcuucgccaccacccugggcgugaacaagugccacgugcagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucaagguggagaacuggaucuucagaaaccccggcuucacccugguggccguggccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucaccugcagcaagaagaugaccggcaagagcauccagcccgagaaccuggaguacagaaucaugcugagcgugcacggcagccagcacagcggcaugaucgugaacgacgagaacagagccaagguggaggugacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacuguucagcggccaccugaagugcagacugaagauggacaagcugagacugaagggcgugagcuacagccugugcaccgccgccuucaccuucaccaaggugcccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgacaagaagaucacccaccacuggcacagaagcggcagcaccaucggcaaggccuucgaggccaccgugagaggcgccaagagaauggccgugcugggcgacaccgccugggacuucggcagcgugggcggcguguucaacagccugggcaagggcauccaccagaucuucggcgccgccuucaagagccuguucggcggcaugagcugguucagccagauccugaucggcacccugcugguguggcugggccugaacaccaagaacggcagcaucagccugaccugccuggcccugggcggcgugaugaucuuccugagcaccgccgugagcgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8714 - RNA, 2278 nt, Artificial Sequence
  KU963573.2 prME-short mRNA Design 3 opt
gggagaaagcuuaccaugaccagcaucggcaucaucggccugcugcugaccaccgccauggccgccgagaucaccagaagaggcagcgccuacuacauguaccuggacagaagcgacgccggcaaggccaucagcuucgccaccacccugggcgugaacaagugccacgugcagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucaagguggagaacuggaucuucagaaaccccggcuucgcccugguggccguggccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucaccugcagcaagaagaugaccggcaagagcauccagcccgagaaccuggaguacagaaucaugcugagcgugcacggcagccagcacagcggcaugaucggcuacgagaccgacgagaacagagccaagguggaggugacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcaagcuguucagcggccaccugaagugcagacugaagauggacaagcugagacugaagggcgugagcuacagccugugcaccgccgccuucaccuucaccaaggugcccgccgagacccugcacggcaccgugaccguggaggugcaguacgccggcaccgacggccccugcaagauccccgugcagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgacaagaagaucacccaccacuggcacagaagcggcagcaccaucggcaaggccuucgaggccaccgugagaggcgccaagagaauggccgugcugggcgacaccgccugggacuucggcagcgugggcggcguguucaacagccugggcaagggcauccaccagaucuucggcgccgccuucaagagccuguucggcggcaugagcugguucagccagauccugaucggcacccugcugguguggcugggccugaacaccaagaacggcagcaucagccugaccugccuggcccugggcggcgugaugaucuuccugagcaccgccgugagcgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8715 - RNA, 2290 nt, Artificial Sequence
  KX694534.2 prME-short mRNA Design 3 opt
gggagaaagcuuaccaugaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcagaggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8716 - RNA, 2290 nt, Artificial Sequence
  KX369547.1 prME-short mRNA Design 3 opt
gggagaaagcuuaccaugaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggccuggcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8717 - RNA, 2290 nt, Artificial Sequence
  KX447515.1 prME-short mRNA Design 3 opt
gggagaaagcuuaccaugaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacugguacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8718 - RNA, 2290 nt, Artificial Sequence
  KU729218.1 prME-short mRNA Design 3 opt
gggagaaagcuuaccaugaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacacccagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8719 - RNA, 2290 nt, Artificial Sequence
  KU501217.1 prME-short mRNA Design 3 opt
gggagaaagcuuaccaugaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgagaucagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8720 - RNA, 2290 nt, Artificial Sequence
  KU312314.1 prME-short mRNA Design 3 opt
gggagaaagcuuaccaugaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcuggcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8721 - RNA, 2290 nt, Artificial Sequence
  KX446950.2 prME-short mRNA Design 3 opt
gggagaaagcuuaccaugaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccacccuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8722 - RNA, 2290 nt, Artificial Sequence
  KY003157.1 prME-short mRNA Design 3 opt
gggagaaagcuuaccaugaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccguggugagcgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8723 - RNA, 2290 nt, Artificial Sequence
  KX811222.1 prME-short mRNA Design 3 opt
gggagaaagcuuaccaugaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcgccugggugguguacggcaccugccaccacaagaagggcgaggccagaagaagcagaagagccgugacccugcccagccacagcaccagaaagcugcagaccagaccccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8724 - RNA, 2290 nt, Artificial Sequence
  KX447516.1 prME-short mRNA Design 3 opt
gggagaaagcuuaccaugaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagcaagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8725 - RNA, 2290 nt, Artificial Sequence
  KX520666.1 prME-short mRNA Design 3 opt
gggagaaagcuuaccaugaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagacagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8726 - RNA, 2290 nt, Artificial Sequence
  KU497555.1 prME-short mRNA Design 3 opt
gggagaaagcuuaccaugaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcacccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8727 - RNA, 2290 nt, Artificial Sequence
  KY075939.1 prME-short mRNA Design 3 opt
gggagaaagcuuaccaugaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagccugagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8728 - RNA, 2290 nt, Artificial Sequence
  KY075932.1 prME-short mRNA Design 3 opt
gggagaaagcuuaccaugaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaaucgagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8729 - RNA, 2290 nt, Artificial Sequence
  KU870645.1 prME-short mRNA Design 3 opt
gggagaaagcuuaccaugaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggauccugagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcaucggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8730 - RNA, 2290 nt, Artificial Sequence
  KU729217.2 prME-short mRNA Design 3 opt
gggagaaagcuuaccaugaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugagcaccaccgugagcaacauggccgaggugagaagcuacugcuacgaggccaccaucagcgacaucgccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgccguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8731 - RNA, 2290 nt, Artificial Sequence
  KX087101.3 prME-short mRNA Design 3 opt
gggagaaagcuuaccaugaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggagcugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8732 - RNA, 2290 nt, Artificial Sequence
  KY014317.1 prME-short mRNA Design 3 opt
gggagaaagcuuaccaugaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaucgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8733 - RNA, 2290 nt, Artificial Sequence
  KU758876.1 prME-short mRNA Design 3 opt
gggagaaagcuuaccaugaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgugaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagcuucaugugccuggcccugggcggcgugcugaucuuccugagcaccgccgugagcgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8734 - RNA, 2290 nt, Artificial Sequence
  KU758874.1 prME-short mRNA Design 3 opt
gggagaaagcuuaccaugaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcaagcugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8735 - RNA, 2290 nt, Artificial Sequence
  KY317939.1 prME-short mRNA Design 3 opt
gggagaaagcuuaccaugaccagcgugggcaucgugggccugcugcugaccaccgccauggccgccgaggugaccagaagaggcagcgccuacuacauguaccuggacagaaaggacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8736 - RNA, 2290 nt, Artificial Sequence
  KY014314.1 prME-short mRNA Design 3 opt
gggagaaagcuuaccaugaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggaggcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8737 - RNA, 2290 nt, Artificial Sequence
  KX447517.1 prME-short mRNA Design 3 opt
gggagaaagcuuaccaugaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccgcccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagacccugaucggcacccugcugauguggcugggccugaacaccaagaacggcagcaucagccugaugugccuggcccugggcggcgugcugaucuuccugagcaccgccgugagcgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8738 - RNA, 2290 nt, Artificial Sequence
  KU926310.1 prME-short mRNA Design 3 opt
gggagaaagcuuaccaugaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcgccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8739 - RNA, 2290 nt, Artificial Sequence
  KU922923.1 prME-short mRNA Design 3 opt
gggagaaagcuuaccaugaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccuggccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8740 - RNA, 2290 nt, Artificial Sequence
  KY075937.1 prME-short mRNA Design 3 opt
gggagaaagcuuaccaugaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggugagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8741 - RNA, 2290 nt, Artificial Sequence
  KY003156.1 prME-short mRNA Design 3 opt
gggagaaagcuuaccaugaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcaucagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcauccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8742 - RNA, 2290 nt, Artificial Sequence
  KU312313.1 prME-short mRNA Design 3 opt
gggagaaagcuuaccaugaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaccugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaucagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacgccaagaacggcagcaucagccugaugugccuggcccugggcggcgugcugaucuuccugagcaccgccgugagcgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8743 - RNA, 2290 nt, Artificial Sequence
  KY075935.1 prME-short mRNA Design 3 opt
gggagaaagcuuaccaugaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggcccagagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8744 - RNA, 2290 nt, Artificial Sequence
  KY014320.1 prME-short mRNA Design 3 opt
gggagaaagcuuaccaugaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcaggccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8745 - RNA, 2290 nt, Artificial Sequence
  KY328290.1 prME-short mRNA Design 3 opt
gggagaaagcuuaccaugaccagcgugggcaucgugggccugcugcugaccaccgccauggccgccgaggugaccagaagaggcagcgccuacuacauguaccuggacagaagcgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucagcaagauccccgccgagacccugcacggcaccgugaccgaggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8746 - RNA, 2290 nt, Artificial Sequence
  KU681081.3 prME-short mRNA Design 3 opt
gggagaaagcuuaccaugaccagcgugggcaucgugggccugcugcugaccaccgccauggccgccgaggugaccagaagaggcagcgccuacuacauguaccuggacagaagcgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacaccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagggcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgugcugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8747 - RNA, 2290 nt, Artificial Sequence
  KX827309.1 prME-short mRNA Design 3 opt
gggagaaagcuuaccaugaccagcgugggcaucgugggccugcugcugaccaccgccauggccgccgaggugaccagaagaggcagcgccuacuacauguaccuggacagaagcgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8748 - RNA, 2290 nt, Artificial Sequence
  KU955593.1 prME-short mRNA Design 3 opt
gggagaaagcuuaccaugaccagcgugggcaucgugggccugcugcugaccaccgccauggccguggaggugaccagaagaggcaacgccuacuacauguaccuggacagaagcgacgccggcgaggccaucagcuuccccaccaccaugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugguguggcugggccugaacaccaagaacggcagcaucagccugaugugccuggcccugggcggcgugcugaucuuccugagcaccgccgugagcgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8749 - RNA, 2290 nt, Artificial Sequence
  KY272987.1 prME-short mRNA Design 3 opt
gggagaaagcuuaccaugaccagcgugggcaucgugggccugcugcugaccaccgccauggccgccgaggugaccagaagaggcagcgccuacuacauguaccuggacagaagcgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccuggugugccuggcccugggcggcgugcugaucuuccugagcaccgccgugagcgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8750 - RNA, 2290 nt, Artificial Sequence
  KY007221.1 prME-short mRNA Design 3 opt
gggagaaagcuuaccaugaccagcgugggcaucgugggccugcugcugaccaccgccauggccgccgaggugaccagaagaggcagcgccuacuacauguaccuggacagaagcgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugaacaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccuggugugccuggcccugggcggcgugcugaucuuccugagcaccgccgugagcgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8751 - RNA, 2290 nt, Artificial Sequence
  EU545988.1 prME-short mRNA Design 3 opt
gggagaaagcuuaccaugaccagcgugggcaucgugggccugcugcugaccaccgccauggccguggaggugaccagaagaggcagcgccuacuacauguaccuggacagaagcgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccgccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugguguggcugggccugaacaccaagaacggcagcaucagccugaccugccuggcccugggcggcgugcugaucuuccugagcaccgccgugagcgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8752 - RNA, 2290 nt, Artificial Sequence
  KU681082.3 prME-short mRNA Design 3 opt
gggagaaagcuuaccaugaccagcgugggcaucgugggccugcugcugaccaccgccauggccguggaggugaccagaagaggcagcgccuacuacauguaccuggacagaagcgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgugaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugguguggcugggccugaacaccaagaacggcagcaucagccugaccugccuggcccugggcggcgugcugaucuuccugagcaccgccgugagcgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8753 - RNA, 2290 nt, Artificial Sequence
  KX601167.1 prME-short mRNA Design 3 opt
gggagaaagcuuaccaugaccagcgugggcaucgugggccugcugcugaccaccgccauggccguggaggugaccagaagaggcagcgccuacuacauguaccuggacagaagcgacgccggcgaggccaucagcuuccccaccacccugggcgugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgacaagaagaucacccaccacugguacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugguguggcugggccugaacaccaagaacggcagcaucagccugaccugccuggcccugggcggcgugcugaucuuccugagcaccgccgugagcgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8754 - RNA, 2290 nt, Artificial Sequence
  KX694533.2 prME-short mRNA Design 3 opt
gggagaaagcuuaccaugaccagcgugggcaucgugggccugcugcugaccaccgccauggccguggaggugaccagaagaggcagcgccuacuacauguaccuggacagaagcgacgccggcaaggccaucagcuuccccaccacccugggcgugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaucggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgacaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugguguggcugggccugaacaccaagaacggcagcaucagccugaccugccuggcccugggcggcgugcugaucuuccugagcaccgccgugagcgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8755 - RNA, 2290 nt, Artificial Sequence
  KY288905.1 prME-short mRNA Design 3 opt
gggagaaagcuuaccaugaccagcaucggcaucgugggccugcugcugaccaccgccauggccgccgagaucaccagaagaggcagcgccuacuacauguaccuggacagaagcgacgccggcaaggccaucagcuucgccaccacccugggcgugaacaagugccacgugcagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucaagguggagaacuggaucuucagaaaccccggcuucacccugguggccguggccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucaccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggaggugacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacuguucagcggccaccugaagugcagacugaagauggacaagcugagacugaagggcgugagcuacagccugugcaccgccgccuucaccuucaccaaggugcccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgacaagaagaucacccaccacuggcacagaagcggcagcaccaucggcaaggccuucgaggccaccgugagaggcgccaagagaauggccgugcugggcgacaccgccugggacuucggcagcgugggcggcguguucaacagccugggcaagggcauccaccagaucuucggcgccgccuucaagagccuguucggcggcaugagcugguucagccagauccugaucggcacccugcugguguggcugggccugaacaccaagaacggcagcaucagccugaccugccuggcccugggcggcgugaugaucuuccugagcaccgccgugagcgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8756 - RNA, 2290 nt, Artificial Sequence
  KF268950.1 prME-short mRNA Design 3 opt
gggagaaagcuuaccaugaccagcaucggcaucaucggccugcugcugaccaccgccauggccgccgagaucaccagaagaggcagcgccuacuacauguaccuggacagaagcgacgccggcaaggccaucagcuucgccaccaaccugggcgugaacaagugccacgugcagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucaagguggagaacuggaucuucagaaaccccggcuucgcccuggccgccguggccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucaccugcagcaagaagaugaccggcaagagcauccagcccgagaaccuggaguacagaaucaugcugagcgugcacggcagccagcacagcggcaugaucgugaacgacaucggccacgagaccgacgagaacagagccaagguggaggugacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacuguucagcggccaccugaagugcagacugaagauggacaagcugagacugaagggcgugagcuacagccugugcaccgccgccuucaccuucaccaaggugcccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgacaagaagaucacccaccacuggcacagaagcggcagcaccaucggcaaggccuucgaggccaccgugagaggcgccaagagaauggccgugcugggcgacaccgccugggacuucggcagcgugggcggcguguucaacagccugggcaagggcgugcaccagaucuucggcgccgccuucaagagccuguucggcggcaugagcugguucagccagauccugaucggcacccugcugguguggcugggccugaacaccaagaacggcagcaucagccugaccugccuggcccugggcggcgugaugaucuuccugagcaccgccgugagcgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8757 - RNA, 2290 nt, Artificial Sequence
  KF383121.1 prME-short mRNA Design 3 opt
gggagaaagcuuaccaugaccagcaucggcaucaucggccugcugcugaccaccgccauggccgccgagaucaccagaagaggcagcgccuacuacauguaccuggacagaagcgacgccggcaaggccaucagcuucgccaccacccugggcgugaacaagugccacgugcagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucaagguggagaacuggaucuucagaaaccccggcuucgcccugguggccguggccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucaccugcagcaagaagaugaccggcaagagcauccagcccgagaaccuggaguacagaaucaugcugagcgugcacggcagccagcacagcggcaugaucgugaacgacaucggccacgagaccgacgagaacagagccaagguggaggugacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacuguucagcggccaccugaagugcagacugaagauggacaagcugagacugaagggcgugagcuacagccugugcaccgccgccuucaccuucaccaaggugcccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgacaagaagaucacccaccacuggcacagaagcggcagcaccaucggcaaggccuucgaggccaccgugagaggcgccaagagaauggccgugcugggcgacaccgccugggacuucggcagcgugggcggcguguucaacagccugggcaagggcauccaccagaucuucggcgccgccuucaagagccuguucggcggcaugagcugguucagccagauccugaucggcacccugcugguguggcugggccugaacaccaagaacggcagcaucagccugaccugccuggcccugggcggcgugaugaucuuccugagcaccgccgugagcgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8758 - RNA, 2272 nt, Artificial Sequence
  KF268949.1 prME-short mRNA Design 3 opt
gggagaaagcuuaccaugaccagcaucggcaucaucggccugcugcugaccaccgccauggccgccgagaucaccagaagaggcagcgccuacuacauguaccuggacagaagcgacgccggcaaggccaucagcuucgccaccaaccugggcgugaacaagugccacgugcagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucaagguggagaacuggaucuucagaaaccccggcuucgcccuggccgccguggccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucaccugcagcaagaagaugaccggcaagagcauccagcccgagaaccuggaguacagaaucaugcugagcgugcacggcagccagcacagcggcaugaucgugaacgacgagaacagagccaagguggaggugacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacuguucagcggccaccugaagugcagacugaagauggacaagcugagacugaagggcgugagcuacagccugugcaccgccgccuucaccuucaccaaggugcccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgacaagaagaucacccaccacuggcacagaagcggcagcaccaucggcaaggccuucgaggccaccgugagaggcgccaagagaauggccgugcugggcgacaccgccugggacuucggcagcgugggcggcguguucaacagccugggcaagggcauccaccagaucuucggcgccgccuucaagagccuguucggcggcaugagcugguucagccagauccugaucggcacccugcugguguggcugggccugaacaccaagaacggcagcaucagccugaccugccuggcccugggcggcgugaugaucuuccugagcaccgccgugagcgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8759 - RNA, 2290 nt, Artificial Sequence
  KU955595.1 prME-short mRNA Design 3 opt
gggagaaagcuuaccaugaccagcaucggcaucgugggccugcugcugaccaccgccauggccgccgagaucaccagaagaggcagcgccuacuacauguaccuggacagaagcgacgccggcaaggccaucagcuucgccaccacccugggcgugaacaagugccacgugcagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucaagguggagaacuggaucuucagaaaccccggcuucgcccugguggccguggccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucaccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggaggugacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacuguucagcggccaccugaagugcagacugaagauggacaagcugagacugaagggcgugagcuacagccugugcaccgccgccuucaccuucaccaaggugcccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgacaagaagaucacccaccacuggcacagaagcggcagcaccaucggcaaggccuucgaggccaccgugagaggcgccaagagaauggccgugcugggcgacaccgccugggacuucggcagcgugggcggcguguucaacagccugggcaagggcauccaccagaucuucggcgccgccuucaagagccuguucggcggcaugagcugguucagccagauccugaucggcacccugcugguguggcugggccugaacaccaagaacggcagcaucagccugaccugccuggcccugggcggcgugaugaucuuccugagcaccgccgugagcgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8760 - RNA, 2290 nt, Artificial Sequence
  KF383116.1 prME-short mRNA Design 3 opt
gggagaaagcuuaccaugaccagcaucggcaucgugggccugcugcugaccaccgccauggccgccgagaucaccagaagaggcagcgccuacuacauguaccuggacagaagcgacgccggcaaggccaucagcuucgccaccacccugggcgugaacaagugccacgugcagaucauggaccugggccacaugugcgacgccaccaugagcuacgagugccccaugcuggacgagggcguggagcccgacgacguggacugcuggugcaacaccaccagcaccugggugguguacggcaccugccagcacaagaagggcgaggccagaagaagcagaagagccgugacccugcccagccacagcaccagaaagcugcagaccagaagccagaccuggcuggagagcagagaguacaccaagcaccugaucaagguggagaacuggaucuucagaaaccccggcuucgcccugguggccguggccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucaccugcagcaagaagaugaccggcaagagcauccagcccgagaaccuggaguacagaaucaugcugagcgugcacggcagccagcacagcggcaugaucgugaacgacaucggccacgagaccgacgagaacagagccaagguggaggugacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacuguucagcggccaccugaagugcagacugaagauggacaagcugagacugaagggcgugagcuacagccugugcaccgccgugugcaccgccgccaaggugcccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgacaagaagaucacccaccacuggcacagaagcggcagcaccaucggcaaggccuucgaggccaccgugagaggcgccaagagaauggccgugcugggcgacaccgccugggacuucggcagcgugggcggcguguucaacagccugggcaagggcauccaccagaucuucggcgccgccuucaagagccuguucggcggcaugagcugguucagccagauccugaucggcacccugcugguguggcugggccugaacaccaagaacggcagcaucagccugaccugccuggcccugggcggcgugaugaucuuccugagcaccgccgugagcgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8761 - RNA, 2272 nt, Artificial Sequence
  KX601166.1 prME-short mRNA Design 3 opt
gggagaaagcuuaccaugaccagcaucggcaucgugggccugcugcugaccaccgccauggccgccgagaucaccagaagaggcagcgccuacuacauguaccuggacagaagcgacgccggcaaggccaucagcuucgccaccacccugggcgugaacaagugccacgugcagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucaagguggagaacuggaucuucagaaaccccggcuucgcccugguggccguggccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucaccugcagcaagaagaugaccggcaagagcauccagcccgagaaccuggaguacagaaucaugcugagcgugcacggcagccagcacagcggcaugaucgugaacgacgagaacagagccaagguggaggugacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacuguucagcggccaccugaagugcagacugaagauggacaagcugagacugaagggcgugagcuacagccugugcaccgccgccuucaccuucaccaaggugcccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgacaagaagaucacccaccacuggcacagaagcggcagcaccaucggcaaggccuucgaggccaccgugagaggcgccaagagaauggccgugcugggcgacaccgccugggacuucggcagcgugggcggcguguucaacagccugggcaagggcauccaccagaucuucggcgccgccuucaagagccuguucggcggcaugagcugguucagccagauccugaucggcacccugcugguguggcugggccugaacaccaagaacggcagcaucagccugaccugccuggcccugggcggcgugaugaucuuccugagcaccgccgugagcgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8762 - RNA, 2290 nt, Artificial Sequence
  KF383118.1 prME-short mRNA Design 3 opt
gggagaaagcuuaccaugaccagcaucggcaucaucggccugcugcugaccaccgccauggccgccgagaucaccagaagaggcagcgccuacuacauguaccuggacagaagcgacgccggcaaggccaucagcuucgccaccacccugggcgugaacaagugccacgugcagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgagaccagaagaagcagaagaagcgugagccugagauaccacuacaccagaaagcugcagaccagaagccagaccuggcuggagagcagagaguacaagaagcaccugaucaugguggagaacuggaucuucagaaaccccggcuucgccaucgugagcguggccaucaccuggcugaugggcagccugaccagccagaaggugaucuaccuggugaugaucgugcugaucgugcccgccuacagcaucagcugcaucggcgugagcaacagagaccugguggagggcaugagcggcggcaccuggguggacguggugcuggagcacggcggcugcgugaccgagauggcccaggacaagcccaccguggacaucgagcuggugaccaugaccgugagcaacauggccgaggugagaagcuacugcuacgaggccagccugagcgacauggccagcgccagcagaugccccacccagggcgagcccagccuggacaagcagagcgacacccagagcgugugcaagagaacccugggcgacagaggcuggggcaacggcugcggcaucuucggcaagggcagccuggugaccugcagcaaguucaccugcugcaagaagaugcccggcaagagcauccagcccgagaaccuggaguacagaaucaugcugcccgugcacggcagccagcacagcggcaugaucgugaacgacaucggccacgagaccgacgagaacagagccaagguggaggugacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacuguucagcggccaccugaagugcagacugaagauggacaagcugagacugaagggcgugagcuacagccugugcaccgccgccuucaccuucaccaaggugcccgccgagacccugcacggcaccgugaccguggaggugcagagcgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgacaagaagaucacccaccacuggcacagaagcggcagcaccaucggcaaggccuucgaggccaccgugagaggcgccaagagaauggccgugcugggcgacaccgccugggacuucggcagcgugggcggcguguucaacagccugggcaagggcauccaccagaucuucggcgccgccuucaagagccuguucggcggcaugagcugguucagccagauccugaucggcacccugcugguguggcugggccugaacaccaagaacggcagcaucagccugaccugccuggcccugggcggcgugaugaucuuccugagcaccgccgugagcgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8763 - RNA, 2287 nt, Artificial Sequence
  KX447520.1 prME-short mRNA Design 3 opt
gggagaaagcuuaccaugagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8764 - RNA, 2290 nt, Artificial Sequence
  KU761561.1 prME-short mRNA Design 3 opt
gggagaaagcuuaccaugaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccagaagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8765 - RNA, 2290 nt, Artificial Sequence
  KX806557.2 prME-short mRNA Design 3 opt
gggagaaagcuuaccaugaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggauguucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8766 - RNA, 2290 nt, Artificial Sequence
  LC191864.1 prME-short mRNA Design 3 opt
gggagaaagcuuaccaugaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaugaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8767 - RNA, 2290 nt, Artificial Sequence
  KU744693.1 prME-short mRNA Design 3 opt
gggagaaagcuuaccaugaccagcgugggcaucgugggccugcugcugaccaccgccauggccgccgaggugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgccauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugcuggugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggcccacaaggagugguuccacgacaucccccugcccuggcacgccggcgccgccaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagaccguggacggcaccgugaccguggagggccaguacggcggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucaucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcggcugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8768 - RNA, 2281 nt, Artificial Sequence
  KU963574.2 prME-short mRNA Design 3 opt
gggagaaagcuuaccaugggcgccgacgccagcaucggcaucgugagccugcugcugaccaccgugauggccgccgagaucaccagaagaggcagcgccuacuacauguaccuggacagaagcgacgccggcaaggccaucagcuucgugaccacccugggcgugaacaagugccacgugcagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucaagguggagaacuggaucuucagaaaccccggcuucgcccugguggccguggccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucaccugcagcaagaagaugaccggcaagagcauccagcccgagaaccuggaguacagaaucaugcugagcgugcacggcagccagcacagcggcaugaucgugaacgacgagaacagagccaagguggaggugacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacagcggcgccgacaccgagaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaaggugcccgccgagacccugcacggcaccgugaccguggaggugcaguacgccggcagagacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgacaagaagaucacccaccacuggcacagaagcggcagcaucaucggcaaggccuucgaggccaccgugagaggcgccaagagaauggccgugcugggcgacaccgccugggacuucggcagcgugggcggcguguucaacagccugggcaagggcauccaccagaucuucggcgccgccuucaagagccuguucggcggcaugagcugguucagccagauccugaucggcacccugcugguguggcugggccugaacaccaagaacggcagcaucagccugaccugccuggcccugggcggcgugaugaucuuccugagcaccgccgugagcgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8769 - RNA, 2299 nt, Artificial Sequence
  KF383120.1 prME-short mRNA Design 3 opt
gggagaaagcuuaccaugggcgccgacaccagcaucggcaucaucggccugcugcugaccaccgccauggccgccgagaucaccagaagaggcagcgccuacuacauguaccuggacagaagcgacgccggcaaggccaucagcuucgccaccaccaugggcgugaacaagugccacgugcagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagacccagcagaagagccgugacccugcccagccacagcaccagaaagcugcagaccagaagccagaccuggcuggagagcagagaguacaccaagcaccugaucaagguggagaacuggauccugagaaaccccggcuucaccguggccgcccuggccauggccuggcugcugggcaacagcaccagccagagagugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucaccugcagcaagaagaugaccggcaagagcauccagcccgagaaccuggaguacagaaucaugcugagcgugcacggcagccagcacagcggcaugaucgugaacgacaucggccacgagaccgacgagaacagagccaagguggaggugacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacuguucagcggccaccugaagugcagaaucaagauggacaagcugagacugaagggcgugagcuacagccugugcaccgccgccuucaccuucagcaaggugcccgccgagacccugcacggcaccgugaccguggaggugcaguacgccggcagagacggccccugcaaggugcccgcccagauggccguggacaugcagacccugacccccgugggcagacugaucaccgccaaccccaucaucaccgagagcaccgagaacagcagaaugaugcuggagcuggacccccccuucggcgacagcuacaucgugaucggcgugggcgacaagaagaucacccaccacuggcacagaagcggcagcaccaucggcaaggccuucgaggccaccgugagaggcgccaagagaauggccgugcugggcgacaccgccugggacuucggcagcgugggcggcguguucaacagccugggcaagggcgugcaccagguguucggcgccgccuucaagagccuguucggcggcaugagcugguucagccagauccugaucggcacccugcugguguggcugggccugaacaccaagaacggcagcaucagccuggccugccuggcccugggcggcgccaugaucuuccugagcaccgccgugagcgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8770 - RNA, 1582 nt, Artificial Sequence; identical to SEQ ID NO: 8545
  KU321639.1 solE mRNA Design 3 opt

SEQ ID NO: 8771 - RNA, 1582 nt, Artificial Sequence; identical to SEQ ID NO: 8546
  KU312312.1 solE mRNA Design 3 opt

SEQ ID NO: 8772 - RNA, 1570 nt, Artificial Sequence; identical to SEQ ID NO: 8547
  AY632535.2 solE mRNA Design 3 opt

SEQ ID NO: 8773 - RNA, 1582 nt, Artificial Sequence; identical to SEQ ID NO: 8546
  KU527068.1 solE mRNA Design 3 opt

SEQ ID NO: 8774 - RNA, 1582 nt, Artificial Sequence
  KX421193.1 solE mRNA Design 3 opt
gggagaaagcuuaccaugagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucaccugcagcaagaagaugaccggcaagagcauccagcccgagaaccuggaguacagaaucaugcugagcgugcacggcagccagcacagcggcaugaucgugaacgacaccggcuacgagaccgacgagaacagagccaagguggaggugacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcaagcuguucagcggccaccugaagugcagacugaagauggacaagcugagacugaagggcgugagcuacagccugugcaccgccgccuucaccuucaccaaggugcccgccgagacccugcacggcaccgugaccguggaggugcaguacgccggcaccgacggccccugcaagauccccgugcagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgacaagaagaucacccaccacuggcacagaagcggcagcaccaucggcaaggccuucgaggccaccgugagaggcgccaagagaauggccgugcugggcgacaccgccugggacuucggcagcugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8775 - RNA, 1582 nt, Artificial Sequence
  LC002520.1 solE mRNA Design 3 opt
gggagaaagcuuaccaugagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucaccugcagcaagaagaugaccggcaagagcauccagcccgagaaccuggaguacagaaucaugcugagcgugcacggcagccagcacagcggcaugaccgugaacgacaucggcuacgagaccgacgagaacagagccaagguggaggugacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcaagcuguucagcggccaccugaagugcagacugaagauggacaagcugagacugaagggcgugagcuacagccugugcaccgccgccuucaccuucaccaaggugcccgccgagacccugcacggcaccgugaccguggaggugcaguacgccggcaccgacggccccugcaagauccccgugcagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgacaagaagaucacccaccacuggcacagaagcggcagcaccaucggcaaggccuucgaggccaccgugagaggcgccaagagaauggccgugcugggcgacaccgccugggacuucggcagcugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8776 - RNA, 1564 nt, Artificial Sequence
  DQ859059.1 solE mRNA Design 3 opt
gggagaaagcuuaccaugagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucaccugcagcaagaagaugaccggcaagagcauccagcccgagaaccuggaguacagaaucaugcugagcgugcacggcagccagcacagcggcaugaucgugaacgacgagaacagagccaagguggaggugacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacuguucagcggccaccugaagugcagacugaagauggacaagcugagacugaagggcgugagcuacagccugugcaccgccgccuucaccuucaccaaggugcccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgacaagaagaucacccaccacuggcacagaagcggcagcaccaucggcaaggccuucgaggccaccgugagaggcgccaagagaauggccgugcugggcgacaccgccugggacuucggcagcugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8777 - RNA, 1570 nt, Artificial Sequence
  KU963573.2 solE mRNA Design 3 opt
gggagaaagcuuaccaugagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucaccugcagcaagaagaugaccggcaagagcauccagcccgagaaccuggaguacagaaucaugcugagcgugcacggcagccagcacagcggcaugaucggcuacgagaccgacgagaacagagccaagguggaggugacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcaagcuguucagcggccaccugaagugcagacugaagauggacaagcugagacugaagggcgugagcuacagccugugcaccgccgccuucaccuucaccaaggugcccgccgagacccugcacggcaccgugaccguggaggugcaguacgccggcaccgacggccccugcaagauccccgugcagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgacaagaagaucacccaccacuggcacagaagcggcagcaccaucggcaaggccuucgaggccaccgugagaggcgccaagagaauggccgugcugggcgacaccgccugggacuucggcagcugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8778 - RNA, 1582 nt, Artificial Sequence
  KY075939.1 solE mRNA Design 3 opt
gggagaaagcuuaccaugagccagaaggugaucuaccuggugaugauccugcugaucgcccccgccuacagccugagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8779 - RNA, 1582 nt, Artificial Sequence
  KX447516.1 solE mRNA Design 3 opt
gggagaaagcuuaccaugagcaagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8780 - RNA, 1582 nt, Artificial Sequence
  KX447515.1 solE mRNA Design 3 opt
gggagaaagcuuaccaugagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacugguacagaagcggcagcaccaucggcaaggccuucgaggccaccgugagaggcgccaagagaauggccgugcugggcgacaccgccugggacuucggcagcugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8781 - RNA, 1582 nt, Artificial Sequence
  KU758874.1 solE mRNA Design 3 opt
gggagaaagcuuaccaugagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcaagcugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8782 - RNA, 1582 nt, Artificial Sequence
  KU729218.1 solE mRNA Design 3 opt
gggagaaagcuuaccaugagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacacccagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8783 - RNA, 1582 nt, Artificial Sequence
  KU501217.1 solE mRNA Design 3 opt
gggagaaagcuuaccaugagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgagaucagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8784 - RNA, 1582 nt, Artificial Sequence
  KU761561.1 solE mRNA Design 3 opt
gggagaaagcuuaccaugagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccagaagaauggccgugcugggcgacaccgccugggacuucggcagcugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8785 - RNA, 1582 nt, Artificial Sequence
  KY075937.1 solE mRNA Design 3 opt
gggagaaagcuuaccaugagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggugagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8786 - RNA, 1582 nt, Artificial Sequence
  KY014317.1 solE mRNA Design 3 opt
gggagaaagcuuaccaugagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaucgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8787 - RNA, 1582 nt, Artificial Sequence
  KU870645.1 solE mRNA Design 3 opt
gggagaaagcuuaccaugagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcaucggcgagaagaagaucacccaccacuggcacagaagcggcagcaccaucggcaaggccuucgaggccaccgugagaggcgccaagagaauggccgugcugggcgacaccgccugggacuucggcagcugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8788 - RNA, 1582 nt, Artificial Sequence
  KU922923.1 solE mRNA Design 3 opt
gggagaaagcuuaccaugagccagaaggugaucuaccuggugaugauccugcugaucgcccuggccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8789 - RNA, 1582 nt, Artificial Sequence
  KU497555.1 solE mRNA Design 3 opt
gggagaaagcuuaccaugagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcacccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8790 - RNA, 1582 nt, Artificial Sequence
  KU312314.1 solE mRNA Design 3 opt
gggagaaagcuuaccaugagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcuggcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8791 - RNA, 1582 nt, Artificial Sequence
  KY014314.1 solE mRNA Design 3 opt
gggagaaagcuuaccaugagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggaggcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8792 - RNA, 1582 nt, Artificial Sequence
  KX447517.1 solE mRNA Design 3 opt
gggagaaagcuuaccaugagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccgcccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8793 - RNA, 1582 nt, Artificial Sequence
  KU729217.2 solE mRNA Design 3 opt
gggagaaagcuuaccaugagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugagcaccaccgugagcaacauggccgaggugagaagcuacugcuacgaggccaccaucagcgacaucgccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgccguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8794 - RNA, 1582 nt, Artificial Sequence
  KY328290.1 solE mRNA Design 3 opt
gggagaaagcuuaccaugagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucagcaagauccccgccgagacccugcacggcaccgugaccgaggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8795 - RNA, 1582 nt, Artificial Sequence
  KX087101.3 solE mRNA Design 3 opt
gggagaaagcuuaccaugagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggagcugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8796 - RNA, 1582 nt, Artificial Sequence
  KY003156.1 solE mRNA Design 3 opt
gggagaaagcuuaccaugagccagaaggugaucuaccuggugaugauccugcugaucgcccccgccuacagcaucagaugcaucggcaucagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcauccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8797 - RNA, 1582 nt, Artificial Sequence
  KU758876.1 solE mRNA Design 3 opt
gggagaaagcuuaccaugagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgugaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8798 - RNA, 1582 nt, Artificial Sequence
  KU926310.1 solE mRNA Design 3 opt
gggagaaagcuuaccaugagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcgccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8799 - RNA, 1582 nt, Artificial Sequence
  KU681081.3 solE mRNA Design 3 opt
gggagaaagcuuaccaugagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacaccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagggcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8800 - RNA, 1582 nt, Artificial Sequence
  KU744693.1 solE mRNA Design 3 opt
gggagaaagcuuaccaugagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgccauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugcuggugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggcccacaaggagugguuccacgacaucccccugcccuggcacgccggcgccgccaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagaccguggacggcaccgugaccguggagggccaguacggcggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8801 - RNA, 1582 nt, Artificial Sequence
  EU545988.1 solE mRNA Design 3 opt
gggagaaagcuuaccaugagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccgccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8802 - RNA, 1582 nt, Artificial Sequence
  KY007221.1 solE mRNA Design 3 opt
gggagaaagcuuaccaugagccagaaggugaucuaccuggugaugauccugcugaucgcccccgccuacagcaucagaugcaucggcgugaacaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8803 - RNA, 1582 nt, Artificial Sequence
  KY003152.1 solE mRNA Design 3 opt
gggagaaagcuuaccaugagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcgccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8804 - RNA, 1582 nt, Artificial Sequence
  KX694533.2 solE mRNA Design 3 opt
gggagaaagcuuaccaugagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaucggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgacaagaagaucacccaccacuggcacagaagcggcagcaccaucggcaaggccuucgaggccaccgugagaggcgccaagagaauggccgugcugggcgacaccgccugggacuucggcagcugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8805 - RNA, 1582 nt, Artificial Sequence
  KX601167.1 solE mRNA Design 3 opt
gggagaaagcuuaccaugagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgacaagaagaucacccaccacugguacagaagcggcagcaccaucggcaaggccuucgaggccaccgugagaggcgccaagagaauggccgugcugggcgacaccgccugggacuucggcagcugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8806 - RNA, 1582 nt, Artificial Sequence
  KY288905.1 solE mRNA Design 3 opt
gggagaaagcuuaccaugagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucaccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggaggugacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacuguucagcggccaccugaagugcagacugaagauggacaagcugagacugaagggcgugagcuacagccugugcaccgccgccuucaccuucaccaaggugcccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgacaagaagaucacccaccacuggcacagaagcggcagcaccaucggcaaggccuucgaggccaccgugagaggcgccaagagaauggccgugcugggcgacaccgccugggacuucggcagcugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8807 - RNA, 1582 nt, Artificial Sequence
  KF268950.1 solE mRNA Design 3 opt
gggagaaagcuuaccaugagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucaccugcagcaagaagaugaccggcaagagcauccagcccgagaaccuggaguacagaaucaugcugagcgugcacggcagccagcacagcggcaugaucgugaacgacaucggccacgagaccgacgagaacagagccaagguggaggugacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacuguucagcggccaccugaagugcagacugaagauggacaagcugagacugaagggcgugagcuacagccugugcaccgccgccuucaccuucaccaaggugcccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgacaagaagaucacccaccacuggcacagaagcggcagcaccaucggcaaggccuucgaggccaccgugagaggcgccaagagaauggccgugcugggcgacaccgccugggacuucggcagcugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8808 - RNA, 1582 nt, Artificial Sequence
  KF383116.1 solE mRNA Design 3 opt
gggagaaagcuuaccaugagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucaccugcagcaagaagaugaccggcaagagcauccagcccgagaaccuggaguacagaaucaugcugagcgugcacggcagccagcacagcggcaugaucgugaacgacaucggccacgagaccgacgagaacagagccaagguggaggugacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacuguucagcggccaccugaagugcagacugaagauggacaagcugagacugaagggcgugagcuacagccugugcaccgccgugugcaccgccgccaaggugcccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgacaagaagaucacccaccacuggcacagaagcggcagcaccaucggcaaggccuucgaggccaccgugagaggcgccaagagaauggccgugcugggcgacaccgccugggacuucggcagcugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8809 - RNA, 1564 nt, Artificial Sequence
  KU963574.2 solE mRNA Design 3 opt
gggagaaagcuuaccaugagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucaccugcagcaagaagaugaccggcaagagcauccagcccgagaaccuggaguacagaaucaugcugagcgugcacggcagccagcacagcggcaugaucgugaacgacgagaacagagccaagguggaggugacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacagcggcgccgacaccgagaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaaggugcccgccgagacccugcacggcaccgugaccguggaggugcaguacgccggcagagacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgacaagaagaucacccaccacuggcacagaagcggcagcaucaucggcaaggccuucgaggccaccgugagaggcgccaagagaauggccgugcugggcgacaccgccugggacuucggcagcugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8810 - RNA, 1582 nt, Artificial Sequence
  KF383118.1 solE mRNA Design 3 opt
gggagaaagcuuaccaugagccagaaggugaucuaccuggugaugaucgugcugaucgugcccgccuacagcaucagcugcaucggcgugagcaacagagaccugguggagggcaugagcggcggcaccuggguggacguggugcuggagcacggcggcugcgugaccgagauggcccaggacaagcccaccguggacaucgagcuggugaccaugaccgugagcaacauggccgaggugagaagcuacugcuacgaggccagccugagcgacauggccagcgccagcagaugccccacccagggcgagcccagccuggacaagcagagcgacacccagagcgugugcaagagaacccugggcgacagaggcuggggcaacggcugcggcaucuucggcaagggcagccuggugaccugcagcaaguucaccugcugcaagaagaugcccggcaagagcauccagcccgagaaccuggaguacagaaucaugcugcccgugcacggcagccagcacagcggcaugaucgugaacgacaucggccacgagaccgacgagaacagagccaagguggaggugacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacuguucagcggccaccugaagugcagacugaagauggacaagcugagacugaagggcgugagcuacagccugugcaccgccgccuucaccuucaccaaggugcccgccgagacccugcacggcaccgugaccguggaggugcagagcgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgacaagaagaucacccaccacuggcacagaagcggcagcaccaucggcaaggccuucgaggccaccgugagaggcgccaagagaauggccgugcugggcgacaccgccugggacuucggcagcugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8811 - RNA, 1582 nt, Artificial Sequence
  KX520666.1 solE mRNA Design 3 opt
gggagaaagcuuaccaugagacagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8812 - RNA, 1582 nt, Artificial Sequence
  KF383120.1 solE mRNA Design 3 opt
gggagaaagcuuaccaugagccagagagugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucaccugcagcaagaagaugaccggcaagagcauccagcccgagaaccuggaguacagaaucaugcugagcgugcacggcagccagcacagcggcaugaucgugaacgacaucggccacgagaccgacgagaacagagccaagguggaggugacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacuguucagcggccaccugaagugcagaaucaagauggacaagcugagacugaagggcgugagcuacagccugugcaccgccgccuucaccuucagcaaggugcccgccgagacccugcacggcaccgugaccguggaggugcaguacgccggcagagacggccccugcaaggugcccgcccagauggccguggacaugcagacccugacccccgugggcagacugaucaccgccaaccccaucaucaccgagagcaccgagaacagcagaaugaugcuggagcuggacccccccuucggcgacagcuacaucgugaucggcgugggcgacaagaagaucacccaccacuggcacagaagcggcagcaccaucggcaaggccuucgaggccaccgugagaggcgccaagagaauggccgugcugggcgacaccgccugggacuucggcagcugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8813 - RNA, 2365 nt, Artificial Sequence
  ZIKV (strain ZikaSPH2015) Polyprotein(93-804) mRNA Design 3 opt
gggagaaagcuuaccaugagaaucauuaacgcccggaaggagaaaaagcgcagaggcgcugacaccagcguggggaucgucggacugcuccugacaacggccauggcggcugaaguuacccggcgcggcuccgccuacuauauguaccuugauagaaaugacgccggggaggcuauuucuuuccccacaacccugggaaugaacaaaugcuauauccagauuauggaucucggccacaugugugacgccacaaugagcuacgaaugcccuaugcuggaugaggggguggaaccggacgauguggacuguuggugcaauaccacauccaccugggucguguauggaacgugucaucacaagaaaggcgaggcucggcgcucuagacgggccguuacccuucccagccauuccacacgcaagcugcaaaccagaucucagacauggcucgagagccgggaauacaccaagcaccugauccgcguggagaacuggaucuuuagaaauccuggcuucgcgcuggccgcugccgcuauugccuggcuccugggguccagcacgucucagaaagucaucuaucuugugaugauucugcucaucgcgcccgccuacuccauucggugcaucggaguuagcaaccgcgauuuuguggaaggcaugucugggggaacaugggucgacauugugcuggagcauggcgggugugugaccgucauggcucaggauaagccuacaguugacaucgagcuugugaccaccacaguguccaauauggccgaagucagaagcuacugcuaugaggcuucuaucuccgauauggccagcgacucccggugucccacgcaaggagaagccuaccuggacaaacagucugauacccaguaugugugcaagagaacacucguugaccgcggcuggggcaacggguguggacuguucggcaaagggagccuggugaccugcgcuaaguuugcgugcuccaagaaaaugacaggaaagagcauucagccugagaaucucgaauaccggaucaugcugucuguccacggcucccaacacagcgggaugauugugaacgauaccggacaugagacggacgagaauagagccaaaguugaaaucacaccgaacucuccccgcgcugaggccacccuuggcggcuucgggagccugggacucgauugugaaccucggaccggccuggacuuuuccgaucuuuauuaccugacaaugaauaacaagcacuggcucgugcauaaagagugguuccacgacauuccccugccuuggcacgccggggcugauaccggaacaccccauuggaauaacaaggaagcccuggucgaguuuaaagacgcgcacgcuaagagacagacgguggucgugcucggcucucaggagggggccguucauaccgcccuggcuggcgcccuugaagcugagauggauggagccaagggccgccugagcuccgggcaccucaaaugccggcugaagauggacaaacuuagacugaagggagugagcuauucucucuguacagcggccuucaccuuuacaaaaaucccggcugaaacccugcauggcacggucaccguggagguucaguacgccgggacagacggaccuugcaaggugcccgcucaaauggccgucgauaugcagacccugacaccugugggccgccucaucaccgcgaaccccgugauuacggaauccacagagaauagcaagaugaugcuggagcuugaucccccuuucggggacucuuacaucguuauuggcgucggagagaaaaagaucacccaccacuggcaucgguccggcagcacaauugggaaagccuuugaagcuaccgugagaggagccaagcgcauggcugugcugggcgacaccgccugggauuucggguccgucggaggcgcccucaacucucuggggaaaggcauccaccagaucuucggagcugcguuuaagagccuguucggcgggauguccugguuuucucaaauucuuaucggaacacuccugauguggcugggccucaauacgaagaacgggagcauuucccugaugugucuugcccugggaggcgugcucaucuuccugagcaccgcuguuucugccgacguggggugcuccgucgauuuuagcaaaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8814 - RNA, 2365 nt, Artificial Sequence
  ZIKV (isolate Z1106033) Polyprotein(93-804) mRNA Design 3 opt
gggagaaagcuuaccaugagaaucauuaacgcccggaaggagaaaaagcgcagaggcgcugacaccagcguggggaucgucggacugcuccugacaacggccauggcggcugaaguuacccggcgcggcuccgccuacuauauguaccuugauagaaaugacgccggggaggcuauuucuuuccccacaacccugggaaugaacaaaugcuauauccagauuauggaucucggccacacaugugacgccaccaugagcuacgaaugcccuaugcuggaugaggggguggaaccggacgauguggacuguuggugcaauacaaccuccacgugggucguguauggaaccugucaucacaagaaaggcgaggcucggcgcucuagacgggccguuacacuucccagccauuccacccgcaagcugcaaacaagaucucagaccuggcucgagagccgggaauacacgaagcaccugauccgcguggagaacuggaucuuuagaaauccuggcuucgcgcuggccgcugccgcuauugccuggcuccugggguccagcacaucucagaaagucaucuaucuugugaugauucugcucaucgcgcccgccuacuccauucggugcaucggaguuagcaaccgcgauuuuguggaaggcaugucugggggaaccugggucgacguggugcuggagcauggcgggugugucacaguuauggcucaggauaagccuaccguggacauugagcuugugaccacaacggucuccaauauggccgaagugagaagcuacugcuaugaggcuucuaucuccgauauggccagcgacucccggugucccacccaaggagaagccuaccuggacaaacagucugauacacaguauguuugcaagagaacccucguggaccgcggcuggggcaacggguguggacuguucggcaaagggagccuggucacaugcgcuaaguuugcgugcuccaagaaaaugaccggaaagagcauccagccugagaaucucgaauaccggauuaugcugucugugcacggcucccaacacagcgggaugaucguuaacgauacgggacaugagacagacgagaauagagccaaaguggaaauuaccccgaacucuccccgcgcugaggccacccuuggcggcuucgggagccugggacucgauugugaaccucggacaggccuggacuuuuccgaucuuuauuaccugaccaugaauaacaagcacuggcucguccauaaagagugguuccacgacaucccccugccuuggcacgccggggcugauacaggaacgccccauuggaauaacaaggaagcccugguggaguuuaaagacgcgcacgcuaagagacagaccgucgugguucucggcucucaggagggggccgugcauacagcccuggcuggcgcccuugaagcugagauggauggagccaagggccgccugagcuccgggcaccucaaaugccggcugaagauggacaaacuuagacugaagggagucagcuauucucucuguaccgcggccuucacauuuaccaaaauuccggcugaaacgcugcauggcaccgugacaguugaggugcaguacgccgggaccgacggaccuugcaagguccccgcucaaauggccguggauaugcagacacugaccccugugggccgccucaucacggcgaaccccguuaucacagaauccaccgagaauagcaagaugaugcuggagcuugaucccccuuucggggacucuuacauugucaucggcgugggagagaaaaagauuacacaccacuggcaucgguccggcagcaccaucgggaaagccuuugaagcuaccgugagaggagccaagcgcauggcuguccugggcgacacagccugggauuucggguccgugggaggcgcccucaacucucuggggaaaggcauucaccagaucuucggagcugcguuuaagagccuguucggcgggauguccugguuuucucaaauccuuauuggaacgcuccugauguggcugggccucaaugccaagaacgggagcaucucccugaugugucuugcucugggaggcguucucauuuuccugagcaccgccgugucugccgacgucgggugcuccguggauuuuagcaaaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8815 - RNA, 2353 nt, Artificial Sequence
  ZIKV (strain MR 766) Polyprotein(93-800) mRNA Design 3 opt
gggagaaagcuuaccaugagaaucauuaacgcccggaaggagcgcaaaagacggggcgcugacaccagcaucgggauuaucggacugcuccugacaacggccauggcggcugaaauuacccgcagaggcuccgccuacuauauguaccuugaucggucugacgccgggaaggcuaucagcuucgccacaacccugggagugaauaaaugccacguccagaucauggaucucggccauaugugugacgcuacaauguccuaugagugccccaugcuggaugaagggguugagcccgacgauguggacuguuggugcaacaccacaucuaccuggguggucuacggaacgugucaccauaagaaaggcgaagcccgcagaagccggcgcgcggugacccuuccgucccacucuacaagaaagcugcaaacccggagccagacauggcucgagucccgcgaguauaccaagcaucugauuaaaguugaaaauuggaucuuuagaaaccccggcuucgcccugguggcugucgccauugcuuggcuccuggggagcucuacgucccagaaggugaucuaccuuguuaugauucugcucaucgccccugcguauagcauucggugcaucggagugucuaaucgcgauuuugucgagggcauguccgggggaacauggguggacgugguccuggaacacggcggguguguuaccgugauggcccaggauaaacccacaguggacaucgagcuugucaccaccacagugagcaacauggcugagguuagaucuuacugcuacgaagccuccauuagcgauauggcuuccgacucucgguguccuacgcaaggagaggccuaucuggacaagcagagcgauacccaguacgugugcaaaagaacacucgucgaccgcggcuggggcaauggguguggacuguucggcaaggggucccuggugaccugcgccaaguuuacaugcagcaaaaagaugaccggaaaaucuauccagcccgaaaaccucgaguaucggauuaugcuguccguucacggcagccaacauucugggaugaucggauacgaaacggaugaggacagagcuaagguggaggucacaccuaauagcccgcgcgcggaagccacccuuggcggcuucgggucccugggacucgauugugagccccggaccggccuggacuuuucugaucuuuauuaccugacaaugaacaauaaacacuggcucgugcauaaggaaugguuccacgacauuccucugcccuggcacgcuggggccgauaccggaacaccucauuggaacaauaaagaggcccuggucgaauuuaaggacgcucacgccaagagacagacggugguugugcucggcagccaggagggggcgguccauaccgcucuggccggcgcccuugaggcugaaauggauggagccaaaggccgccuguucuccgggcaccucaagugccggcugaaaauggacaaacuuagacugaagggagugagcuauucucucuguacagcugccuuuaccuucacaaagguucccgcggagacccugcauggcacggugaccgucgaagugcaguacgccgggacagacggaccgugcaagaucccugugcaaauggcuguugauaugcagacccugacacccgucggccgccucaucaccgccaacccugugauuacggaguccacagaaaauagcaaaaugaugcuggagcuugacccucccuuuggggauucuuacaucgugauuggcgucggagacaagaaaaucacccaccacuggcaucgguccggcagcacaauugggaaggcuuucgaggccaccgugagaggagcgaaacgcauggccguucugggcgauaccgcuugggacuucggguccgugggaggcgucuuuaacucucucgggaagggcauccaccagaucuucggagccgcuuuuaagagccuguucggcgggauguccugguuuucucaaauucugaucggaacacuucucguguggcugggccugaacacgaaaaaugggagcauuucccucaccugucuggcccuuggaggcguuaugaucuuccugagcacagccgugucugcugaugucgggugcuccguggacuuuagcaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8816 - RNA, 2365 nt, Artificial Sequence
  ZIKV (strain NatalRGN) Polyprotein(93-804) mRNA Design 3 opt
gggagaaagcuuaccaugagaaucauuaacgcccggaaggagaaaaagcgcagaggcgcugacaccagcguggggaucgucggacugcuccugacaacggccauggcggcugaaguuacccggcgcggcuccgccuacuauauguaccuugauagaaaugacgccggggaggcuauuucuuuccccacaacccugggaaugaacaaaugcuauauccagauuauggaucucggccacaugugugacgccacaaugagcuacgaaugcccuaugcuggaugaggggguggaaccggacgauguggacuguuggugcaauaccacauccaccugggucguguauggaacgugucaucacaagaaaggcgaggcucggcgcucuagacgggccguuacccuucccagccauuccacacgcaagcugcaaaccagaucucagacauggcucgagagccgggaauacaccaagcaccugauccgcguggagaacuggaucuuuagaaauccuggcuucgcgcuggccgcugccgcuauugccuggcuccugggguccagcacgucucagaaagucaucuaucuugugaugauucugcucaucgcgcccgccuacuccauucggugcaucggaguuagcaaccgcgauuuuguggaaggcaugucugggggaacaugggucgacguggugcuggagcauggcgggugugucaccguuauggcucaggauaagccuacaguggacauugagcuugugaccaccacagucuccaauauggccgaagugagaagcuacugcuaugaggcuucuaucuccgauauggccagcgacucccggugucccacgcaaggagaagccuaccuggacaaacagucugauacccaguauguuugcaagagaacacucguggaccgcggcuggggcaacggguguggacuguucggcaaagggagccuggugaccugcgcuaaguuugcgugcuccaagaaaaugacaggaaagagcauccagccugagaaucucgaauaccggauuaugcugucuguccacggcucccaacacagcgggaugaucguuaacgauaccggacaugagacggacgagaauagagccaaaguggaaauuacaccgaacucuccccgcgcugaggccacccuuggcggcuucgggagccugggacucgauugugaaccucggaccggccuggacuuuuccgaucuuuauuaccugacaaugaauaacaagcacuggcucguccauaaagagugguuccacgacaucccccugccuuggcacgccggggcugauaccggaacaccccauuggaauaacaaggaagcccugguggaguuuaaagacgcgcacgcuaagagacagacggucgugguucucggcucucaggagggggccgugcauaccgcccuggcuggcgcccuugaagcugagauggauggagccaagggccgccugagcuccgggcaccucaaaugccggcugaagauggacaaacuuagacugaagggagucagcuauucucucuguacagcggccuucaccuuuacaaaaauuccggcugaaacccugcauggcacggugaccguugaggugcaguacgccgggacagacggaccuugcaagguccccgcucaaauggccguggauaugcagacccugacaccugugggccgccucaucaccgcgaaccccguuaucacggaauccacagagaauagcaagaugaugcuggagcuugaucccccuuucggggacucuuacauugucaucggcgugggagagaaaaagauuacccaccacuggcaucgguccggcagcacaaucgggaaagccuuugaagcuaccgugagaggagccaagcgcauggcuguccugggcgacaccgccugggauuucggguccgugggaggcgcccucaacucucuggggaaaggcauucaccagaucuucggagcugcguuuaagagccuguucggcgggauguccugguuuucucaaauccuuauuggaacacuccugauguggcugggccucaauacgaagaacgggagcaucucccugaugugucuugcccugggaggcguucucauuuuccugagcaccgcugugucugccgacgucgggugcuccguggauuuuagcaaaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8817 - RNA, 2290 nt, Artificial Sequence
  ZIKV (strain ZikaSPH2015) Polyprotein(108-794) mRNA Design 3 opt
gggagaaagcuuaccaugaccagcgugggcaucgucgggcugcuccugacaacggccauggcugccgagguuaccagacggggauccgcguacuauauguaccuugaccgcaacgaugcuggcgaagccauuucuuuccccacaacccuggggaugaauaagugcuauauccagauuauggaccucggacacaugugugaugccacaaugagcuacgagugcccuaugcuggacgaaggcguggagccggaugacguggauuguuggugcaacaccacauccaccugggucguguaugggacgugucaucacaaaaagggagaagcuagacggucucgcagagccguuacccuucccagccauuccacacggaaacugcaaacccgcucucagacauggcucgagagcagagaguacaccaagcaccugauccggguggaaaauuggauuuuucgcaacccuggcuucgcucuggccgcggccgcuaucgccuggcuccugggcuccagcacgucucagaaagucaucuaucuugugaugauucugcucaucgcucccgccuacuccauuagaugcaucgggguuagcaaucgggacuuuguggagggaaugucuggcgggacaugggucgauauugugcuggaacauggaggcugugugaccgucauggcgcaggacaagccuacaguugauaucgagcuugugaccaccacaguguccaacauggccgagguccgcagcuacugcuaugaagcuagcauuuccgacauggccagcgauuccagaugucccacgcaaggggaggcuuaccuggacaagcagucugacacccaguaugugugcaaacggacacucguugaucgcggauggggcaauggcugugggcuguucggaaagggcagccuggugaccugcgccaaauuugccugcuccaagaaaaugacagggaagucuauccagccugaaaaccucgaguacagaaucaugcugucuguccacggaucccaacacagcggcaugauugugaaugacaccgggcaugaaacggaugagaaccgggcuaagguugagaucacacccaauucuccgagagcggaagccacccuuggaggcuucggcagccuggggcucgacugugagccucgcaccggacuggauuuuuccgaccuuuauuaccugacaaugaacaauaaacacuggcucgugcauaaggaaugguuccacgauauuccccugccuuggcacgcuggcgccgacaccgggacaccccauuggaacaauaaagaggcccuggucgaauuuaaggaugcucacgccaaacggcagacgguggucgugcucggaucucaggagggcgcgguucauaccgcucuggccggggcccuugaggcugaaauggacggcgccaagggaagacugagcuccggccaccucaaaugccgccugaagauggauaagcugcggcugaaaggggugagcuauucucucuguacagcugccuucaccuuuacaaagaucccggcggagacccugcauggaacggucaccguggaaguucaguacgccggcacagacgggccuugcaaagugcccgcucaaauggccgucgacaugcagacccugacaccugugggaagacucauuaccgcuaaccccgugaucacggaguccacagaaaacagcaagaugaugcuggagcuugaucccccuuucggcgacucuuacaucguuauuggggucggcgagaaaaagaucacccaccacuggcaucgcuccggaagcacaauuggcaaggccuuugaagcgaccgugagaggggccaaacggauggcugugcugggagauaccgccugggacuucggcuccgucgggggagcucucaauucucugggcaaggggauccaccagauuuucggcgccgccuuuaaaagccuguucggaggcauguccugguuuucucaaauccuuaucgggacacuccugauguggcugggacucaacacgaagaauggcagcauuucccugaugugucuugcucuugggggagugcucaucuuccugagcaccgcgguuucugccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8818 - RNA, 2290 nt, Artificial Sequence
  ZIKV (isolate Z1106033) Polyprotein(108-794) mRNA Design 3 opt
gggagaaagcuuaccaugaccagcgugggcaucgucgggcugcuccugacaacggccauggcugccgagguuaccagacggggauccgcguacuauauguaccuugaccgcaacgaugcuggcgaagccauuucuuuccccacaacccuggggaugaauaagugcuauauccagauuauggaccucggacacacaugugaugccaccaugagcuacgagugcccuaugcuggacgaaggcguggagccggaugacguggauuguuggugcaacacaaccuccacgugggucguguaugggaccugucaucacaaaaagggagaagcuagacggucucgcagagccguuacacuucccagccauuccacccggaaacugcaaacacgcucucagaccuggcucgagagcagagaguacacgaagcaccugauccggguggaaaauuggauuuuucgcaacccuggcuucgcucuggccgcggccgcuaucgccuggcuccugggcuccagcacaucucagaaagucaucuaucuugugaugauucugcucaucgcucccgccuacuccauuagaugcaucgggguuagcaaucgggacuuuguggagggaaugucuggcgggaccugggucgauguggugcuggaacauggaggcugugucacaguuauggcgcaggacaagccuaccguggauauugagcuugugaccacaacggucuccaacauggccgaggugcgcagcuacugcuaugaagcuagcaucuccgacauggccagcgauuccagaugucccacccaaggggaggcuuaccuggacaagcagucugacacacaguauguuugcaaacggacccucguggaucgcggauggggcaauggcugugggcuguucggaaagggcagccuggucacaugcgccaaauuugccugcuccaagaaaaugaccgggaagucuauucagccugaaaaccucgaguacagaaucaugcugucugugcacggaucccaacacagcggcaugaucguuaaugacacggggcaugaaacagaugagaaccgggcuaagguggagauuacccccaauucuccgagagcggaagccacccuuggaggcuucggcagccuggggcucgacugugagccucgcacaggacuggauuuuuccgaccuuuauuaccugaccaugaacaauaaacacuggcucguccauaaggaaugguuccacgauaucccccugccuuggcacgcuggcgccgacacagggacgccccauuggaacaauaaagaggcccugguggaauuuaaggaugcucacgccaaacggcagaccgucgugguucucggaucucaggagggcgcggugcauacagcucuggccggggcccuugaggcugaaauggacggcgccaagggaagacugagcuccggccaccucaaaugccgccugaagauggauaagcugcggcugaaaggggucagcuauucucucuguaccgcugccuucacauuuaccaagauuccggcggagacgcugcauggaaccgugacaguugaagugcaguacgccggcaccgacgggccuugcaaaguccccgcucaaauggccguggacaugcagacacugaccccugugggaagacucaucacggcuaaccccguuauuacagaguccaccgaaaacagcaagaugaugcuggagcuugaucccccuuucggcgacucuuacaucgucaucggggugggcgagaaaaagauuacacaccacuggcaucgcuccggaagcaccaucggcaaggccuuugaagcgaccgugagaggggccaaacggauggcuguccugggagauacagccugggacuucggcuccguugggggagcucucaauucucugggcaaggggauucaccagaucuucggcgccgccuuuaaaagccuguucggaggcauguccugguuuucucaaauucuuaucgggacgcuccugauguggcugggacucaacgcuaagaauggcagcaucucccugaugugucuugcgcuugggggagugcucauuuuccugagcaccgccgugucugcuugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8819 - RNA, 2278 nt, Artificial Sequence
  ZIKV (strain MR 766) Polyprotein(108-790) mRNA Design 3 opt
gggagaaagcuuaccaugaccagcaucggcauuaucgggcugcuccugacaacggccauggcugccgagauuaccagacggggauccgcguacuauauguaccuugaccgcucugaugcuggcaaggccaucagcuucgccacaacccugggggugaacaaaugccacguccagauuauggaccucggacauaugugugaugcuacaauguccuaugaaugccccaugcuggacgagggcguugaacccgaugacguggauuguuggugcaauaccacaucuaccuggguggucuacgggacgugucaccauaagaaaggagaggccagacggagccgcagagcugugacccuuccgucccacucuacacggaagcugcaaacccgcagccagacauggcucgaauccagagaguauaccaaacaucugaucaagguugagaacuggaucuuucggaaucccggcuucgcccugguggcggucgccauugcuuggcuccugggcagcucuacgucccagaaggugaucuaccuuguuaugauucugcucaucgccccugcuuauagcauucgcugcaucggggugucuaacagagacuuugucgaaggaauguccggcgggacauggguggaugugguccuggagcacggaggcuguguuaccgugauggcccaggacaaacccacaguggauauugaacuugucaccaccacagugagcaauauggcggagguucggucuuacugcuacgaggccuccaucagcgacauggcuuccgauucucgcuguccuacgcaaggggaagccuaucuggacaagcagagcgacacccaguacgugugcaaaagaacacucgucgaucggggauggggcaacggcugugggcuguucggaaagggcucccuggugaccugcgcuaaauuuacaugcagcaagaagaugaccgggaaaucuauccagcccgagaaucucgaauaucgcauuaugcuguccguucacggaagccaacauucuggcaugaucggguacgagacggacgaagauagagccaagguggaggucacaccuaacagcccgcgggccgaggcuacccuuggaggcuucggcucccuggggcucgacugugaacccagaaccggacuggauuuuucugaccuuuauuaccugacaaugaauaacaaacacuggcucgugcauaaggagugguuccacgauauuccucugcccuggcacgcgggcgccgacaccgggacaccucauuggaauaacaaagaagcucuggucgaguuuaaggaugcccacgccaaacgccagacggugguugugcucggaagccaggaaggcgcuguccauaccgcccuggcgggggcucuugaggccgagauggacggcgccaagggacggcuguucuccggccaccucaagugcagacugaaaauggauaaacuucgccugaagggggugagcuauucucucuguacagcugccuuuaccuucacaaagguucccgcugaaacccugcauggaacggugaccgucgaggugcaguacgccggcacagacgggccgugcaaaaucccugugcaaauggcgguugacaugcagacccugacacccgucggacggcucauuaccgccaauccugugaucacggaauccacagagaacagcaagaugaugcuggaacuugauccucccuuuggcgacucuuacaucgugauuggggucggcgauaagaaaaucacccaccacuggcauagauccggaagcacaauuggcaaggcuuucgaggccaccgugcgcggggcuaaacggauggccguucugggagacaccgcgugggauuucggcuccgucgggggaguguuuaauucucucggcaaggggauccaccagauuuucggcgccgcuuuuaaaagccuguucggaggcauguccugguuuucucaaauccugaucgggacacuucucguguggcugggacugaacacgaagaacggcagcauuucccucaccugucuggcccuugggggaguuaugaucuuccugagcacagcugugucugccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8820 - RNA, 2290 nt, Artificial Sequence
  ZIKV (strain NatalRGN) Polyprotein(108-794) mRNA Design 3 opt
gggagaaagcuuaccaugaccagcgugggcaucgucgggcugcuccugacaacggccauggcugccgagguuaccagacggggauccgcguacuauauguaccuugaccgcaacgaugcuggcgaagccauuucuuuccccacaacccuggggaugaauaagugcuauauccagauuauggaccucggacacaugugugaugccacaaugagcuacgagugcccuaugcuggacgaaggcguggagccggaugacguggauuguuggugcaacaccacauccaccugggucguguaugggacgugucaucacaaaaagggagaagcuagacggucucgcagagccguuacccuucccagccauuccacacggaaacugcaaacccgcucucagacauggcucgagagcagagaguacaccaagcaccugauccggguggaaaauuggauuuuucgcaacccuggcuucgcucuggccgcggccgcuaucgccuggcuccugggcuccagcacgucucagaaagucaucuaucuugugaugauucugcucaucgcucccgccuacuccauuagaugcaucgggguuagcaaucgggacuuuguggagggaaugucuggcgggacaugggucgauguggugcuggaacauggaggcugugucaccguuauggcgcaggacaagccuacaguggauauugagcuugugaccaccacagucuccaacauggccgaggugcgcagcuacugcuaugaagcuagcaucuccgacauggccagcgauuccagaugucccacgcaaggggaggcuuaccuggacaagcagucugacacccaguauguuugcaaacggacacucguggaucgcggauggggcaauggcugugggcuguucggaaagggcagccuggugaccugcgccaaauuugccugcuccaagaaaaugacagggaagucuauucagccugaaaaccucgaguacagaaucaugcugucugugcacggaucccaacacagcggcaugaucguuaaugacaccgggcaugaaacggaugagaaccgggcuaagguggagauuacacccaauucuccgagagcggaagccacccuuggaggcuucggcagccuggggcucgacugugagccucgcaccggacuggauuuuuccgaccuuuauuaccugacaaugaacaauaaacacuggcucguccauaaggaaugguuccacgauaucccccugccuuggcacgcuggcgccgacaccgggacaccccauuggaacaauaaagaggcccugguggaauuuaaggaugcucacgccaaacggcagacggucgugguucucggaucucaggagggcgcggugcauaccgcucuggccggggcccuugaggcugaaauggacggcgccaagggaagacugagcuccggccaccucaaaugccgccugaagauggauaagcugcggcugaaaggggucagcuauucucucuguacagcugccuucaccuuuacaaagauuccggcggagacccugcauggaacggugaccguugaagugcaguacgccggcacagacgggccuugcaaaguccccgcucaaauggccguggacaugcagacccugacaccugugggaagacucaucaccgcuaaccccguuauuacggaguccacagaaaacagcaagaugaugcuggagcuugaucccccuuucggcgacucuuacaucgucaucggggugggcgagaaaaagauuacccaccacuggcaucgcuccggaagcacaaucggcaaggccuuugaagcgaccgugagaggggccaaacggauggcuguccugggagauaccgccugggacuucggcuccgucgggggagcucucaauucucugggcaaggggauucaccagaucuucggcgccgccuuuaaaagccuguucggaggcauguccugguuuucucaaauucuuaucgggacacuccugauguggcugggacucaacacgaagaauggcagcaucucccugaugugucuugcucuugggggaguucucauuuuccugagcaccgcggugucugccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8821 - RNA, 1582 nt, Artificial Sequence
  ZIKV (strain ZikaSPH2015) Polyprotein(273-723) mRNA Design 3 opt
gggagaaagcuuaccaugagccagaaggugaucuaccuggucaugauucuccugaucgcccccgcuuauuccauuagaugcaucggcguuucuaaccgggacuucguggaggggaugagcggaggcaccuggguggauauuguccuugaacacgggggaugugugacaguuauggcccaagacaaaccuacgguggauaucgagcuggucaccacaaccguguccaauauggcggaaguucgcucuuacugcuaugaggcuagcaucuccgacauggccucugauagcagauguccgacacagggcgaagccuaccucgacaagcaguccgauacccaguaugugugcaaacggacacuggucgaccgcggguggggaaacggcuguggccuuuuugggaagggaagccuggugaccugcgcuaaauucgccuguucuaagaagaugacgggcaaauccauucaacccgagaaucucgaguacagaaucaugcugagcgugcaugggucucagcacuccggaaugauugucaacgauaccggccaugaaacagacgagaaucgggcuaagguugaaaucaccccuaacagcccccgcgccgaggcgacacucgggggauuuggcucucugggccuggauugcgagccuagaaccgggcuugacuucuccgaucuguauuaccucacgaugaauaacaaacacuggcuggugcauaaggaaugguuucacgacauuccccuuccuuggcacgccggagcugacacaggcaccccgcauuggaauaacaaagaggcccugguggaguucaaggaugcucacgccaagcggcagacagucgugguucucgggagccaggaaggagcggugcauaccgcccuggcuggcgcccuggaagcugagauggacggggccaaaggacgccucuccucuggccaccugaaguguagacuuaaaauggauaagcugcggcucaaaggcgucagcuacucccugugcaccgccgcuuuuacauucacgaagauccccgcggagacccuucacgggacagugaccguugaagugcaauaugccggaacagacggcccuuguaaaguccccgcucagauggccguggauaugcagacccugacgccugucgggcgccucauuacagccaaucccgugaucaccgagagcaccgaaaacucuaagaugaugcuggagcuggacccgccuuuuggagauuccuacaucguuauuggcgugggggaaaagaaaaucacacaucacuggcauagaagcggcucuaccauuggaaaggcuuucgaggccacaguccggggcgcgaaacgcauggcugugcucggggacacggccugggauuuuggaagcugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8822 - RNA, 1582 nt, Artificial Sequence
  ZIKV (isolate Z1106033) Polyprotein(273-723) mRNA Design 3 opt
gggagaaagcuuaccaugagccagaaggugaucuaccuggucaugauucuccugaucgcccccgcuuauuccauuagaugcaucggcguuucuaaccgggacuucguggaggggaugagcggaggcaccuggguggaugucgugcuugaacacgggggauguguuacagugauggcccaagacaaaccuacggucgauauugagcuggugaccacaaccguuuccaauauggcggaagugcgcucuuacugcuaugaggcuagcaucuccgacauggccucugauagcagauguccgacacagggcgaagccuaccucgacaagcaguccgauacccaguaugucugcaaacggacacugguggaccgcggguggggaaacggcuguggccuuuuugggaagggaagccuggugaccugcgcuaaauucgccuguucuaagaagaugacgggcaaauccauccaacccgagaaucucgaguacagaauuaugcugagcguccaugggucucagcacuccggaaugaucguuaacgauaccggccaugaaacagacgagaaucgggcuaagguggaaauuaccccuaacagcccccgcgccgaggcgacacucgggggauuuggcucucugggccuggauugcgagccuagaaccgggcuugacuucuccgaucuguauuaccucacgaugaauaacaaacacuggcuggugcauaaggaaugguuucacgacaucccccuuccuuggcacgccggagcugacacaggcaccccgcauuggaauaacaaagaggcccuggucgaguucaaggaugcucacgccaagcggcagacagugguugugcucgggagccaggaaggagcgguccauaccgcccuggcuggcgcccuggaagcugagauggacggggccaaaggacgccucuccucuggccaccugaaguguagacuuaaaauggauaagcugcggcucaaaggcgugagcuacucccugugcaccgccgcuuuuacauucacgaagauucccgcggagacccuucacgggacaguuaccguggaaguccaauaugccggaacagacggcccuuguaaagugcccgcucagauggccgucgauaugcagacccugacgccuguggggcgccucaucacagccaaucccguuauuaccgagagcaccgaaaacucuaagaugaugcuggagcuggacccgccuuuuggagauuccuacaucgugaucggcgucggggaaaagaaaauuacacaucacuggcauagaagcggcucuaccaucggaaaggcuuucgaggccacagugcggggcgcgaaacgcauggcuguucucggggacacggccugggauuuuggaagcugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8823 - RNA, 1570 nt, Artificial Sequence
  ZIKV (strain MR 766) Polyprotein(273-719) mRNA Design 3 opt
gggagaaagcuuaccaugagccagaaggugaucuaccuggucaugauucuccugaucgcccccgcuuauuccauuagaugcaucggcguuucuaaccgggacuucguggaggggaugagcggaggcaccuggguggaugucgugcuugaacacgggggauguguuacagugauggcccaagacaaaccuacggucgauauugagcuggugaccacaaccguuuccaauauggcggaagugcgcucuuacugcuaugaggcuagcaucuccgacauggccucugauagcagauguccgacacagggcgaagccuaccucgacaagcaguccgauacccaguaugucugcaaacggacacugguggaccgcggguggggaaacggcuguggccuuuuugggaagggaagccuggugaccugcgcuaaauucacguguucuaagaagaugaccggcaaauccauccaacccgagaaucucgaguacagaauuaugcugagcguccaugggucucagcacuccggaaugaucggcuaugaaacagaugaggaccgggccaagguugaagugaccccuaacagcccccgcgcugaggccacacucgggggauuuggcucucugggccuggauugcgagccuagaaccgggcuugacuucuccgaucuguacuaccucacgaugaauaacaaacauuggcuggugcacaaggaaugguuucaugacauuccccuuccuuggcacgcgggagccgacacaggcaccccgcacuggaauaacaaagaggcucuggucgaguucaaggaugcccaugcuaagcggcagacagugguugugcucgggagccaggaaggagccguccacaccgcgcuggccggcgcucuggaagccgagauggacggggcuaaaggacgccucuuuuccggccaucugaaguguagacuuaaaauggauaagcugcggcucaaaggcgugucuuauagccugugcaccgccgccuucacauuuacgaagguucccgcugagacccuucacgggacagugaccgucgaagugcaauacgcgggaacagacggcccuuguaaaauccccguccagauggccguggauaugcagacccugacgccuguugggcgccucauuacagcuaaucccgugaucaccgaguccaccgaaaacagcaagaugaugcuggagcuggacccgccuuucggagauucuuauauugucaucggcgugggggacaagaaaaucacacaccauuggcacagauccggcagcaccauuggaaaggccuuugaagccacaguucggggcgcuaaacgcauggccgugcucggggauacggcgugggacuucggaucuugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8824 - RNA, 1582 nt, Artificial Sequence; identical to SEQ ID NO: 8822
  ZIKV (strain NatalRGN) Polyprotein(273-723) mRNA Design 3 opt

SEQ ID NO: 8825 - RNA, 2290 nt, Artificial Sequence
  ZIKV (strain ZikaSPH2015) Polyprotein(108-794)(F398S) mRNA Design 3 opt
gggagaaagcuuaccaugaccagcgugggcaucgucgggcugcuccugacaacggccauggcugccgagguuaccagacggggauccgcguacuauauguaccuugaccgcaacgaugcuggcgaagccauuucuuuccccacaacccuggggaugaauaagugcuauauccagauuauggaccucggacacaugugugaugccacaaugagcuacgagugcccuaugcuggacgaaggcguggagccggaugacguggauuguuggugcaacaccacauccaccugggucguguaugggacgugucaucacaaaaagggagaagcuagacggucucgcagagccguuacccuucccagccauuccacacggaaacugcaaacccgcucucagacauggcucgagagcagagaguacaccaagcaccugauccggguggaaaauuggauuuuucgcaacccuggcuucgcucuggccgcggccgcuaucgccuggcuccugggcuccagcacgucucagaaagucaucuaucuugugaugauucugcucaucgcucccgccuacuccauuagaugcaucgggguuagcaaucgggacuuuguggagggaaugucuggcgggacaugggucgauauugugcuggaacauggaggcugugugaccgucauggcgcaggacaagccuacaguugauaucgagcuugugaccaccacaguguccaacauggccgagguccgcagcuacugcuaugaagccucuauuuccgacauggcuagcgauuccagaugucccacgcaaggggaggcuuaccuggacaagcagucugacacccaguaugugugcaaacggacacucguugaucgcggauggggcaauggcugugggcugagcggaaagggcucccuggugaccugcgccaaauucgccugcagcaagaaaaugacagggaagucuauccagccugaaaaccucgaguacagaaucaugcuguccguccacggaagccaacacucuggcaugauugugaaugacaccgggcaugaaacggaugagaaccgggcuaagguugagaucacaccgaauagccccagagcggaagccacccuuggaggcuuuggcucccuggggcucgacugugagccucgcaccggacuggauuucucugaccuuuauuaccugacaaugaacaauaaacacuggcucgugcauaaggaaugguuucacgauauuccccugccuuggcacgcuggcgccgacaccgggacaccccauuggaacaauaaagaggcccuggucgaguucaaggaugcucacgccaaacggcagacgguggucgugcucggaagccaggaaggcgcgguucauaccgcucuggccggggcccuugaggcugaaauggacggcgccaagggaagacuguccagcggccaccucaaaugccgccugaagauggauaagcugcggcugaaaggggugucuuauucccucuguacagcugccuuuaccuucacaaagaucccggcggagacccugcauggaacggucaccguggaaguucaguacgccggcacagacgggccuugcaaagugcccgcucaaauggccgucgacaugcagacccugacaccugugggaagacucauuaccgcuaaccccgugaucacggagagcacagaaaacucuaagaugaugcuggagcuugaucccccuuuuggcgacuccuacaucguuauuggggucggcgagaaaaagaucacccaccacuggcaucgcagcggauccacaauuggcaaggccuucgaagcgaccgugagaggggccaaacggauggcugugcugggagauaccgccugggacuuuggcucugucgggggagcucucaauagccugggcaaggggauccaccagauuuucggcgccgccuucaaaucccuguuuggaggcaugucuugguucagccaaauccuuaucgggacacuccugauguggcugggacucaacacgaagaauggcuccauuagccugaugugucuugcucuugggggagugcucaucuuucugucuaccgcgguuuccgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8826 - RNA, 2290 nt, Artificial Sequence
  ZIKV (isolate Z1106033) Polyprotein(108-794)(F398S) mRNA Design 3 opt
gggagaaagcuuaccaugaccagcgugggcaucgucgggcugcuccugacaacggccauggcugccgagguuaccagacggggauccgcguacuauauguaccuugaccgcaacgaugcuggcgaagccauuucuuuccccacaacccuggggaugaauaagugcuauauccagauuauggaccucggacacacaugugaugccaccaugagcuacgagugcccuaugcuggacgaaggcguggagccggaugacguggauuguuggugcaacacaaccuccacgugggucguguaugggaccugucaucacaaaaagggagaagcuagacggucucgcagagccguuacacuucccagccauuccacccggaaacugcaaacacgcucucagaccuggcucgagagcagagaguacacgaagcaccugauccggguggaaaauuggauuuuucgcaacccuggcuucgcucuggccgcggccgcuaucgccuggcuccugggcuccagcacaucucagaaagucaucuaucuugugaugauucugcucaucgcucccgccuacuccauuagaugcaucgggguuagcaaucgggacuuuguggagggaaugucuggcgggaccugggucgauguggugcuggaacauggaggcugugucacaguuauggcgcaggacaagccuaccguggauauugagcuugugaccacaacggucuccaacauggccgaggugcgcagcuacugcuaugaagccucuaucuccgacauggcuagcgauuccagaugucccacccaaggggaggcuuaccuggacaagcagucugacacacaguauguuugcaaacggacccucguggaucgcggauggggcaauggcugugggcugagcggaaagggcucccuggucacaugcgccaaauucgccugcagcaagaaaaugaccgggaagucuauucagccugaaaaccucgaguacagaaucaugcuguccgugcacggaagccaacacucuggcaugaucguuaaugacacggggcaugaaacagaugagaaccgggcuaagguggagauuaccccgaauagccccagagcggaagccacccuuggaggcuuuggcucccuggggcucgacugugagccucgcacaggacuggauuucucugaccuuuauuaccugaccaugaacaauaaacacuggcucguccauaaggaaugguuucacgauaucccccugccuuggcacgcuggcgccgacacagggacgccccauuggaacaauaaagaggcccugguggaguucaaggaugcucacgccaaacggcagaccgucgugguucucggaagccaggaaggcgcggugcauacagcucuggccggggcccuugaggcugaaauggacggcgccaagggaagacuguccagcggccaccucaaaugccgccugaagauggauaagcugcggcugaaaggggucucuuauucccucuguaccgcugccuuuacauucaccaagauuccggcggagacgcugcauggaaccgugacaguugaagugcaguacgccggcaccgacgggccuugcaaaguccccgcucaaauggccguggacaugcagacacugaccccugugggaagacucaucacggcuaaccccguuauuacagagagcaccgaaaacucuaagaugaugcuggagcuugaucccccuuuuggcgacuccuacaucgucaucggggugggcgagaaaaagauuacacaccacuggcaucgcagcggauccaccaucggcaaggccuucgaagcgaccgugagaggggccaaacggauggcuguccugggagauacagccugggacuuuggcucuguugggggagcucucaauagccugggcaaggggauucaccagaucuucggcgccgccuucaaaucccuguuuggaggcaugucuugguucagccaaauucuuaucgggacgcuccugauguggcugggacucaacgcuaagaauggcuccaucagccugaugugucuugcgcuugggggagugcucauuuuucugucuaccgccguguccgcuugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8827 - RNA, 2278 nt, Artificial Sequence
  ZIKV (strain MR 766) Polyprotein(108-790)(F398S) mRNA Design 3 opt
gggagaaagcuuaccaugaccagcaucggcauuaucgggcugcuccugacaacggccauggcugccgagauuaccagacggggauccgcguacuauauguaccuugaccgcucugaugcuggcaaggccaucagcuucgccacaacccugggggugaacaaaugccacguccagauuauggaccucggacauaugugugaugcuacaauguccuaugaaugccccaugcuggacgagggcguugaacccgaugacguggauuguuggugcaauaccacaucuaccuggguggucuacgggacgugucaccauaagaaaggagaggccagacggagccgcagagcugugacccuuccgucccacucuacacggaagcugcaaacccgcagccagacauggcucgaauccagagaguauaccaaacaucugaucaagguugagaacuggaucuuucggaaucccggcuucgcccugguggcggucgccauugcuuggcuccugggcagcucuacgucccagaaggugaucuaccuuguuaugauucugcucaucgccccugcuuauagcauucgcugcaucggggugucuaacagagacuuugucgaaggaauguccggcgggacauggguggaugugguccuggagcacggaggcuguguuaccgugauggcccaggacaaacccacaguggauauugaacuugucaccaccacagugagcaauauggcggagguucggucuuacugcuacgaggccuccaucagcgacauggcuuccgauucucgcuguccuacgcaaggggaagccuaucuggacaagcagagcgacacccaguacgugugcaaaagaacacucgucgaucggggauggggcaacggcugugggcuguccggaaagggcagccuggugaccugcgcuaaauucacaugcucuaagaagaugaccgggaaauccauccagcccgagaaucucgaauaucgcauuaugcugagcguucacggaucucaacauagcggcaugaucggguacgagacggacgaagauagagccaagguggaggucacaccuaacuccccgcgggccgaggcuacccuuggaggcuuuggcucucuggggcucgacugugaacccagaaccggacuggauuucagcgaccuuuauuaccugacaaugaauaacaaacacuggcucgugcauaaggagugguuucacgauauuccucugcccuggcacgcgggcgccgacaccgggacaccucauuggaauaacaaagaagcucuggucgaguucaaggaugcccacgccaaacgccagacggugguugugcucggaucccaggaaggcgcuguccauaccgcccuggcgggggcucuugaggccgagauggacggcgccaagggacggcuguuuagcggccaccucaagugcagacugaaaauggauaaacuucgccugaagggggugucuuauucccucuguacagcugccuucaccuuuacaaagguucccgcugaaacccugcauggaacggugaccgucgaggugcaguacgccggcacagacgggccgugcaaaaucccugugcaaauggcgguugacaugcagacccugacacccgucggacggcucauuaccgccaauccugugaucacggaaagcacagagaacucuaagaugaugcuggaacuugauccucccuucggcgacuccuacaucgugauuggggucggcgauaagaaaaucacccaccacuggcauagaagcggauccacaauuggcaaggcuuuugaggccaccgugcgcggggcuaaacggauggccguucugggagacaccgcgugggauuucggcucugucgggggaguguucaauagccucggcaaggggauccaccagauuuuuggcgccgcuuucaaaucccuguuuggaggcaugucuugguucagccaaauccugaucgggacacuucucguguggcugggacugaacacgaagaacggcuccauuagccucaccugucuggcccuugggggaguuaugaucuuucugucuacagcuguguccgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8828 - RNA, 2290 nt, Artificial Sequence
  ZIKV (strain NatalRGN) Polyprotein(108-794)(F399S) mRNA Design 3 opt
gggagaaagcuuaccaugaccagcgugggcaucgucgggcugcuccugacaacggccauggcugccgagguuaccagacggggauccgcguacuauauguaccuugaccgcaacgaugcuggcgaagccauuucuuuccccacaacccuggggaugaauaagugcuauauccagauuauggaccucggacacaugugugaugccacaaugagcuacgagugcccuaugcuggacgaaggcguggagccggaugacguggauuguuggugcaacaccacauccaccugggucguguaugggacgugucaucacaaaaagggagaagcuagacggucucgcagagccguuacccuucccagccauuccacacggaaacugcaaacccgcucucagacauggcucgagagcagagaguacaccaagcaccugauccggguggaaaauuggauuuuucgcaacccuggcuucgcucuggccgcggccgcuaucgccuggcuccugggcuccagcacgucucagaaagucaucuaucuugugaugauucugcucaucgcucccgccuacuccauuagaugcaucgggguuagcaaucgggacuuuguggagggaaugucuggcgggacaugggucgauguggugcuggaacauggaggcugugucaccguuauggcgcaggacaagccuacaguggauauugagcuugugaccaccacagucuccaacauggccgaggugcgcagcuacugcuaugaagccucuaucuccgacauggcuagcgauuccagaugucccacgcaaggggaggcuuaccuggacaagcagucugacacccaguauguuugcaaacggacacucguggaucgcggauggggcaauggcugugggcugagcggaaagggcucccuggugaccugcgccaaauucgccugcagcaagaaaaugacagggaagucuauucagccugaaaaccucgaguacagaaucaugcuguccgugcacggaagccaacacucuggcaugaucguuaaugacaccgggcaugaaacggaugagaaccgggcuaagguggagauuacaccgaauagccccagagcggaagccacccuuggaggcuuuggcucccuggggcucgacugugagccucgcaccggacuggauuucucugaccuuuauuaccugacaaugaacaauaaacacuggcucguccauaaggaaugguuucacgauaucccccugccuuggcacgcuggcgccgacaccgggacaccccauuggaacaauaaagaggcccugguggaguucaaggaugcucacgccaaacggcagacggucgugguucucggaagccaggaaggcgcggugcauaccgcucuggccggggcccuugaggcugaaauggacggcgccaagggaagacuguccagcggccaccucaaaugccgccugaagauggauaagcugcggcugaaaggggucucuuauucccucuguacagcugccuuuaccuucacaaagauuccggcggagacccugcauggaacggugaccguugaagugcaguacgccggcacagacgggccuugcaaaguccccgcucaaauggccguggacaugcagacccugacaccugugggaagacucaucaccgcuaaccccguuauuacggagagcacagaaaacucuaagaugaugcuggagcuugaucccccuuuuggcgacuccuacaucgucaucggggugggcgagaaaaagauuacccaccacuggcaucgcagcggauccacaaucggcaaggccuucgaagcgaccgugagaggggccaaacggauggcuguccugggagauaccgccugggacuuuggcucugucgggggagcucucaauagccugggcaaggggauucaccagaucuucggcgccgccuucaaaucccuguuuggaggcaugucuugguucagccaaauucuuaucgggacacuccugauguggcugggacucaacacgaagaauggcuccaucagccugaugugucuugcucuugggggaguucucauuuuucugucuaccgcgguguccgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8829 - RNA, 2290 nt, Artificial Sequence
  ZIKV (strain ZikaSPH2015) Polyprotein(108-794)(N444Q) mRNA Design 3 opt
gggagaaagcuuaccaugaccagcgugggcaucgucgggcugcuccugacaacggccauggcugccgagguuaccagacggggauccgcguacuauauguaccuugaccgcaacgaugcuggcgaagccauuucuuuccccacaacccuggggaugaauaagugcuauauccagauuauggaccucggacacaugugugaugccacaaugagcuacgagugcccuaugcuggacgaaggcguggagccggaugacguggauuguuggugcaacaccacauccaccugggucguguaugggacgugucaucacaaaaagggagaagcuagacggucucgcagagccguuacccuucccagccauuccacacggaaacugcaaacccgcucucagacauggcucgagagcagagaguacaccaagcaccugauccggguggaaaauuggauuuuucgcaacccuggcuucgcucuggccgcggccgcuaucgccuggcuccugggcuccagcacgucucagaaagucaucuaucuugugaugauucugcucaucgcucccgccuacuccauuagaugcaucgggguuagcaaucgggacuuuguggagggaaugucuggcgggacaugggucgauauugugcuggaacauggaggcugugugaccgucauggcgcaggacaagccuacaguugauaucgagcuugugaccaccacaguguccaacauggccgagguccgcagcuacugcuaugaagcuagcauuuccgacauggccagcgauuccagaugucccacgcaaggggaggcuuaccuggacaagcagucugacacccaguaugugugcaaacggacacucguugaucgcggauggggcaauggcugugggcuguucggaaagggcagccuggugaccugcgccaaauuugccugcuccaagaaaaugacagggaagucuauccagccugaaaaccucgaguacagaaucaugcugucuguccacggaucccaacacagcggcaugauugugcaggacaccgggcaugaaacggaugagaaucgggcuaagguugagaucacaccgaacucucccagagcggaagccacccuuggaggcuucggcagccuggggcucgacugugagccucgcaccggacuggauuuuuccgaccuuuauuaccugacaaugaauaacaaacacuggcucgugcauaaggaaugguuccacgauauuccccugccuuggcacgcuggcgccgacaccgggacaccccauuggaauaacaaagaggcccuggucgaauuuaaggaugcucacgccaaacggcagacgguggucgugcucggaucucaggagggcgcgguucauaccgcucuggccggggcccuugaggcugaaauggacggcgccaagggaagacugagcuccggccaccucaaaugccgccugaagauggauaagcugcggcugaaaggggugagcuauucucucuguacagcugccuucaccuuuacaaagaucccggcggagacccugcauggaacggucaccguggaaguucaauacgccggcacagacgggccuugcaaagugcccgcucagauggccgucgacaugcagacccugacaccugugggaagacucauuaccgcuaaucccgugaucacggaguccacagaaaacagcaagaugaugcuggagcuugaucccccuuucggcgacucuuacaucguuauuggggucggcgagaaaaagaucacccaccacuggcaucgcuccggaagcacaauuggcaaggccuuugaagcgaccgugagaggggccaaacggauggcugugcugggagauaccgccugggacuucggcuccgucgggggagcucucaacucucugggcaaggggauccaccaaauuuucggcgccgccuuuaaaagccuguucggaggcauguccugguuuucucagauccuuaucgggacacuccugauguggcugggacucaauacgaagaacggcagcauuucccugaugugucuugcucuugggggagugcucaucuuccugagcaccgcgguuucugccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8830 - RNA, 2290 nt, Artificial Sequence
  ZIKV (isolate Z1106033) Polyprotein(108-794)(N444Q) mRNA Design 3 opt
gggagaaagcuuaccaugaccagcgugggcaucgucgggcugcuccugacaacggccauggcugccgagguuaccagacggggauccgcguacuauauguaccuugaccgcaacgaugcuggcgaagccauuucuuuccccacaacccuggggaugaauaagugcuauauccagauuauggaccucggacacacaugugaugccaccaugagcuacgagugcccuaugcuggacgaaggcguggagccggaugacguggauuguuggugcaacacaaccuccacgugggucguguaugggaccugucaucacaaaaagggagaagcuagacggucucgcagagccguuacacuucccagccauuccacccggaaacugcaaacacgcucucagaccuggcucgagagcagagaguacacgaagcaccugauccggguggaaaauuggauuuuucgcaacccuggcuucgcucuggccgcggccgcuaucgccuggcuccugggcuccagcacaucucagaaagucaucuaucuugugaugauucugcucaucgcucccgccuacuccauuagaugcaucgggguuagcaaucgggacuuuguggagggaaugucuggcgggaccugggucgauguggugcuggaacauggaggcugugucacaguuauggcgcaggacaagccuaccguggauauugagcuugugaccacaacggucuccaacauggccgaggugcgcagcuacugcuaugaagcuagcaucuccgacauggccagcgauuccagaugucccacccaaggggaggcuuaccuggacaagcagucugacacacaguauguuugcaaacggacccucguggaucgcggauggggcaauggcugugggcuguucggaaagggcagccuggucacaugcgccaaauuugccugcuccaagaaaaugaccgggaagucuauucagccugaaaaccucgaguacagaaucaugcugucugugcacggaucccaacacagcggcaugaucguucaggacacggggcaugaaacagaugagaaucgggcuaagguggagauuaccccgaacucucccagagcggaagccacccuuggaggcuucggcagccuggggcucgacugugagccucgcacaggacuggauuuuuccgaccuuuauuaccugaccaugaauaacaaacacuggcucguccauaaggaaugguuccacgauaucccccugccuuggcacgcuggcgccgacacagggacgccccauuggaauaacaaagaggcccugguggaauuuaaggaugcucacgccaaacggcagaccgucgugguucucggaucucaggagggcgcggugcauacagcucuggccggggcccuugaggcugaaauggacggcgccaagggaagacugagcuccggccaccucaaaugccgccugaagauggauaagcugcggcugaaaggggucagcuauucucucuguaccgcugccuucacauuuaccaagauuccggcggagacgcugcauggaaccgugacaguugaagugcaauacgccggcaccgacgggccuugcaaaguccccgcucagauggccguggacaugcagacacugaccccugugggaagacucaucacggcuaaucccguuauuacagaguccaccgaaaacagcaagaugaugcuggagcuugaucccccuuucggcgacucuuacaucgucaucggggugggcgagaaaaagauuacacaccacuggcaucgcuccggaagcaccaucggcaaggccuuugaagcgaccgugagaggggccaaacggauggcuguccugggagauacagccugggacuucggcuccguugggggagcucucaacucucugggcaaggggauucaccaaaucuucggcgccgccuuuaaaagccuguucggaggcauguccugguuuucucagauucuuaucgggacgcuccugauguggcugggacucaaugcuaagaacggcagcaucucccugaugugucuugcgcuugggggagugcucauuuuccugagcaccgccgugucugcuugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8831 - RNA, 2290 nt, Artificial Sequence
  ZIKV (strain NatalRGN) Polyprotein(108-794)(N444Q) mRNA Design 3 opt
gggagaaagcuuaccaugaccagcgugggcaucgucgggcugcuccugacaacggccauggcugccgagguuaccagacggggauccgcguacuauauguaccuugaccgcaacgaugcuggcgaagccauuucuuuccccacaacccuggggaugaauaagugcuauauccagauuauggaccucggacacaugugugaugccacaaugagcuacgagugcccuaugcuggacgaaggcguggagccggaugacguggauuguuggugcaacaccacauccaccugggucguguaugggacgugucaucacaaaaagggagaagcuagacggucucgcagagccguuacccuucccagccauuccacacggaaacugcaaacccgcucucagacauggcucgagagcagagaguacaccaagcaccugauccggguggaaaauuggauuuuucgcaacccuggcuucgcucuggccgcggccgcuaucgccuggcuccugggcuccagcacgucucagaaagucaucuaucuugugaugauucugcucaucgcucccgccuacuccauuagaugcaucgggguuagcaaucgggacuuuguggagggaaugucuggcgggacaugggucgauguggugcuggaacauggaggcugugucaccguuauggcgcaggacaagccuacaguggauauugagcuugugaccaccacagucuccaacauggccgaggugcgcagcuacugcuaugaagcuagcaucuccgacauggccagcgauuccagaugucccacgcaaggggaggcuuaccuggacaagcagucugacacccaguauguuugcaaacggacacucguggaucgcggauggggcaauggcugugggcuguucggaaagggcagccuggugaccugcgccaaauuugccugcuccaagaaaaugacagggaagucuauucagccugaaaaccucgaguacagaaucaugcugucugugcacggaucccaacacagcggcaugaucguucaggacaccgggcaugaaacggaugagaaucgggcuaagguggagauuacaccgaacucucccagagcggaagccacccuuggaggcuucggcagccuggggcucgacugugagccucgcaccggacuggauuuuuccgaccuuuauuaccugacaaugaauaacaaacacuggcucguccauaaggaaugguuccacgauaucccccugccuuggcacgcuggcgccgacaccgggacaccccauuggaauaacaaagaggcccugguggaauuuaaggaugcucacgccaaacggcagacggucgugguucucggaucucaggagggcgcggugcauaccgcucuggccggggcccuugaggcugaaauggacggcgccaagggaagacugagcuccggccaccucaaaugccgccugaagauggauaagcugcggcugaaaggggucagcuauucucucuguacagcugccuucaccuuuacaaagauuccggcggagacccugcauggaacggugaccguugaagugcaauacgccggcacagacgggccuugcaaaguccccgcucagauggccguggacaugcagacccugacaccugugggaagacucaucaccgcuaaucccguuauuacggaguccacagaaaacagcaagaugaugcuggagcuugaucccccuuucggcgacucuuacaucgucaucggggugggcgagaaaaagauuacccaccacuggcaucgcuccggaagcacaaucggcaaggccuuugaagcgaccgugagaggggccaaacggauggcuguccugggagauaccgccugggacuucggcuccgucgggggagcucucaacucucugggcaaggggauucaccaaaucuucggcgccgccuuuaaaagccuguucggaggcauguccugguuuucucagauucuuaucgggacacuccugauguggcugggacucaauacgaagaacggcagcaucucccugaugugucuugcucuugggggaguucucauuuuccugagcaccgcggugucugccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8832 - RNA, 2290 nt, Artificial Sequence
  ZIKV (strain ZikaSPH2015) Polyprotein(108-694)-Cterm-JAEV1-E(400-500) mRNA Design 3 opt
gggagaaagcuuaccaugaccagcgugggcaucgucgggcugcuccugacaacggccauggcugccgagguuaccagacggggauccgcguacuauauguaccuugaccgcaacgaugcuggcgaagccauuucuuuccccacaacccuggggaugaauaagugcuauauccagauuauggaccucggacacaugugugaugccacaaugagcuacgagugcccuaugcuggacgaaggcguggagccggaugacguggauuguuggugcaacaccacauccaccugggucguguaugggacgugucaucacaaaaagggagaagcuagacggucucgcagagccguuacccuucccagccauuccacacggaaacugcaaacccgcucucagacauggcucgagagcagagaguacaccaagcaccugauccggguggaaaauuggauuuuucgcaacccuggcuucgcucuggccgcggccgcuaucgccuggcuccugggcuccagcacgucucagaaagucaucuaucuugugaugauucugcucaucgcucccgccuacuccauuagaugcaucgggguuagcaaucgggacuuuguggagggaaugucuggcgggacaugggucgauauugugcuggaacauggaggcugugugaccgucauggcgcaggacaagccuacaguugauaucgagcuugugaccaccacaguguccaacauggccgagguccgcagcuacugcuaugaagcuagcauuuccgacauggccagcgauuccagaugucccacgcaaggggaggcuuaccuggacaagcagucugacacccaguaugugugcaaacggacacucguugaucgcggauggggcaauggcugugggcuguucggaaagggcagccuggugaccugcgccaaauuugccugcuccaagaaaaugacagggaagucuauccagccugaaaaccucgaguacagaaucaugcugucuguccacggaucccaacacagcggcaugauugugaaugacaccgggcaugaaacggaugagaaccgggcuaagguugagaucacacccaauucuccgagagcggaagccacccuuggaggcuucggcagccuggggcucgacugugagccucgcaccggacuggauuuuuccgaccuuuauuaccugacaaugaacaauaaacacuggcucgugcauaaggaaugguuccacgauauuccccugccuuggcacgcuggcgccgacaccgggacaccccauuggaacaauaaagaggcccuggucgaauuuaaggaugcucacgccaaacggcagacgguggucgugcucggaucucaggagggcgcgguucauaccgcucuggccggggcccuugaggcugaaauggacggcgccaagggaagacugagcuccggccaccucaaaugccgccugaagauggauaaacuucggcugaagggggugagcuauucucucuguacagcugccuucaccuuuacaaagaucccggcggagacccugcauggaacggucaccguggaaguucaguacgccggcacagacgggccuugcaaagugcccgcucaaauggccgucgacaugcagacccugacaccugugggaagacucauuaccgcuaaccccgugaucacggaguccacagaaaacagcaagaugaugcuggagcuugaucccccuuucggcgacucuuacaucguuauuggggucggcgagaaaaagaucacccaccacuggcaucgcuccggaagcacacugggcaaggccuuuuccaccacccucaaaggggcgcagcggcuggccgcucugggagauacagccugggacuucggcucuauugggggaguguucaauagcaucggcagagcugugcaccaagucuuugggggcgccuuccgcacgcuuuuuggaggcauguccuggauuacccaggggcucaugggagcccugcugcucuggaugggcgugaacgcucgggauagaucuaucgcgcuggccuuccuugcuacagggggaguucugguguuucucgccaccaauguccaugccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8833 - RNA, 2290 nt, Artificial Sequence
  ZIKV (isolate Z1106033) Polyprotein(108-694)-Cterm-JAEV1-E(400-500) mRNA Design 3 opt
gggagaaagcuuaccaugaccagcgugggcaucgucgggcugcuccugacaacggccauggcugccgagguuaccagacggggauccgcguacuauauguaccuugaccgcaacgaugcuggcgaagccauuucuuuccccacaacccuggggaugaauaagugcuauauccagauuauggaccucggacacacaugugaugccaccaugagcuacgagugcccuaugcuggacgaaggcguggagccggaugacguggauuguuggugcaacacaaccuccacgugggucguguaugggaccugucaucacaaaaagggagaagcuagacggucucgcagagccguuacacuucccagccauuccacccggaaacugcaaacacgcucucagaccuggcucgagagcagagaguacacgaagcaccugauccggguggaaaauuggauuuuucgcaacccuggcuucgcucuggccgcggccgcuaucgccuggcuccugggcuccagcacaucucagaaagucaucuaucuugugaugauucugcucaucgcucccgccuacuccauuagaugcaucgggguuagcaaucgggacuuuguggagggaaugucuggcgggaccugggucgauguggugcuggaacauggaggcugugucacaguuauggcgcaggacaagccuaccguggauauugagcuugugaccacaacggucuccaacauggccgaggugcgcagcuacugcuaugaagcuagcaucuccgacauggccagcgauuccagaugucccacccaaggggaggcuuaccuggacaagcagucugacacacaguauguuugcaaacggacccucguggaucgcggauggggcaauggcugugggcuguucggaaagggcagccuggucacaugcgccaaauuugccugcuccaagaaaaugaccgggaagucuauucagccugaaaaccucgaguacagaaucaugcugucugugcacggaucccaacacagcggcaugaucguuaaugacacggggcaugaaacagaugagaaccgggcuaagguggagauuacccccaauucuccgagagcggaagccacccuuggaggcuucggcagccuggggcucgacugugagccucgcacaggacuggauuuuuccgaccuuuauuaccugaccaugaacaauaaacacuggcucguccauaaggaaugguuccacgauaucccccugccuuggcacgcuggcgccgacacagggacgccccauuggaacaauaaagaggcccugguggaauuuaaggaugcucacgccaaacggcagaccgucgugguucucggaucucaggagggcgcggugcauacagcucuggccggggcccuugaggcugaaauggacggcgccaagggaagacugagcuccggccaccucaaaugccgccugaagauggauaaacuucggcugaagggggucagcuauucucucuguaccgcugccuucacauuuaccaagauuccggcggagacgcugcauggaaccgugacaguugaagugcaguacgccggcaccgacgggccuugcaaaguccccgcucaaauggccguggacaugcagacacugaccccugugggaagacucaucacggcuaaccccguuauuacagaguccaccgaaaacagcaagaugaugcuggagcuugaucccccuuucggcgacucuuacaucgucaucggggugggcgagaaaaagauuacacaccacuggcaucgcuccggaagcacccugggcaaggccuuuuccaccacacucaaaggggcgcagcggcuggccgcucugggagauacggccugggacuucggcucuaucgggggaguguucaauagcauuggcagagcuguccaccaaguguuugggggcgccuuccgcacccuuuuuggaggcauguccuggaucacacaggggcucaugggagcccugcugcucuggaugggcguuaacgcucgggauagaucuauugcgcuggccuuccuugcuaccgggggagugcuggucuuucucgccacaaaugugcaugccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8834 - RNA, 2278 nt, Artificial Sequence
  ZIKV (strain MR 766) Polyprotein(108-690)-Cterm-JAEV1-E(400-500) mRNA Design 3 opt
gggagaaagcuuaccaugaccagcaucggcauuaucgggcugcuccugacaacggccauggcugccgagauuaccagacggggauccgcguacuauauguaccuugaccgcucugaugcuggcaaggccaucagcuucgccacaacccugggggugaacaaaugccacguccagauuauggaccucggacauaugugugaugcuacaauguccuaugaaugccccaugcuggacgagggcguugaacccgaugacguggauuguuggugcaauaccacaucuaccuggguggucuacgggacgugucaccauaagaaaggagaggccagacggagccgcagagcugugacccuuccgucccacucuacacggaagcugcaaacccgcagccagacauggcucgaauccagagaguauaccaaacaucugaucaagguugagaacuggaucuuucggaaucccggcuucgcccugguggcggucgccauugcuuggcuccugggcagcucuacgucccagaaggugaucuaccuuguuaugauucugcucaucgccccugcuuauagcauucgcugcaucggggugucuaacagagacuuugucgaaggaauguccggcgggacauggguggaugugguccuggagcacggaggcuguguuaccgugauggcccaggacaaacccacaguggauauugaacuugucaccaccacagugagcaauauggcggagguucggucuuacugcuacgaggccuccaucagcgacauggcuuccgauucucgcuguccuacgcaaggggaagccuaucuggacaagcagagcgacacccaguacgugugcaaaagaacacucgucgaucggggauggggcaacggcugugggcuguucggaaagggcucccuggugaccugcgcuaaauuuacaugcagcaagaagaugaccgggaaaucuauccagcccgagaaucucgaauaucgcauuaugcuguccguucacggaagccaacauucuggcaugaucggguacgagacggacgaagauagagccaagguggaggucacaccuaacagcccgcgggccgaggcuacccuuggaggcuucggcucccuggggcucgacugugaacccagaaccggacuggauuuuucugaccuuuauuaccugacaaugaauaacaaacacuggcucgugcauaaggagugguuccacgauauuccucugcccuggcacgcgggcgccgacaccgggacaccucauuggaauaacaaagaagcucuggucgaguuuaaggaugcccacgccaaacgccagacggugguugugcucggaagccaggaaggcgcuguccauaccgcccuggcgggggcucuugaggccgagauggacggcgccaagggacggcuguucuccggccaccucaagugcagacugaaaauggauaaacuucgccugaagggggugagcuauucucucuguacagcugccuuuaccuucacaaagguucccgcugaaacccugcauggaacggugaccgucgaggugcaguacgccggcacagacgggccgugcaaaaucccugugcaaauggcgguugacaugcagacccugacacccgucggacggcucauuaccgccaauccugugaucacggaauccacagagaacagcaagaugaugcuggaacuugauccucccuuuggcgacucuuacaucgugauuggggucggcgauaagaaaaucacccaccacuggcauagauccggaagcacacugggcaaggcuuucuccaccacccucaaaggggcccagcgccuggcugcccugggagacacagcgugggauuucggcucuauugggggaguguuuaauagcaucggccgggccguucaccaaguguucgggggcgcuuuuagaacgcuuuucggaggcauguccuggauuacccaggggcucaugggagcccugcugcucuggaugggcgucaacgcucgcgaccggucuaucgcccuggccuuucuugcuacagggggagugcugguuuuccucgcgaccaacgugcaugccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8835 - RNA, 2290 nt, Artificial Sequence
  ZIKV (strain NatalRGN) Polyprotein(108-694)-Cterm-JAEV1-E(400-500) mRNA Design 3 opt
gggagaaagcuuaccaugaccagcgugggcaucgucgggcugcuccugacaacggccauggcugccgagguuaccagacggggauccgcguacuauauguaccuugaccgcaacgaugcuggcgaagccauuucuuuccccacaacccuggggaugaauaagugcuauauccagauuauggaccucggacacaugugugaugccacaaugagcuacgagugcccuaugcuggacgaaggcguggagccggaugacguggauuguuggugcaacaccacauccaccugggucguguaugggacgugucaucacaaaaagggagaagcuagacggucucgcagagccguuacccuucccagccauuccacacggaaacugcaaacccgcucucagacauggcucgagagcagagaguacaccaagcaccugauccggguggaaaauuggauuuuucgcaacccuggcuucgcucuggccgcggccgcuaucgccuggcuccugggcuccagcacgucucagaaagucaucuaucuugugaugauucugcucaucgcucccgccuacuccauuagaugcaucgggguuagcaaucgggacuuuguggagggaaugucuggcgggacaugggucgauguggugcuggaacauggaggcugugucaccguuauggcgcaggacaagccuacaguggauauugagcuugugaccaccacagucuccaacauggccgaggugcgcagcuacugcuaugaagcuagcaucuccgacauggccagcgauuccagaugucccacgcaaggggaggcuuaccuggacaagcagucugacacccaguauguuugcaaacggacacucguggaucgcggauggggcaauggcugugggcuguucggaaagggcagccuggugaccugcgccaaauuugccugcuccaagaaaaugacagggaagucuauucagccugaaaaccucgaguacagaaucaugcugucuguccacggaucccaacacagcggcaugaucguuaaugacaccgggcaugaaacggaugagaaccgggcuaagguggagauuacacccaauucuccgagagcggaagccacccuuggaggcuucggcagccuggggcucgacugugagccucgcaccggacuggauuuuuccgaccuuuauuaccugacaaugaacaauaaacacuggcucguccauaaggaaugguuccacgauaucccccugccuuggcacgcuggcgccgacaccgggacaccccauuggaacaauaaagaggcccugguggaauuuaaggaugcucacgccaaacggcagacggucgugguucucggaucucaggagggcgcggugcauaccgcucuggccggggcccuugaggcugaaauggacggcgccaagggaagacugagcuccggccaccucaaaugccgccugaagauggauaaacuucggcugaagggggucagcuauucucucuguacagcugccuucaccuuuacaaagauuccggcggagacccugcauggaacggugaccguugaagugcaguacgccggcacagacgggccuugcaaaguccccgcucaaauggccguggacaugcagacccugacaccugugggaagacucaucaccgcuaaccccguuauuacggaguccacagaaaacagcaagaugaugcuggagcuugaucccccuuucggcgacucuuacaucgucaucggggugggcgagaaaaagauuacccaccacuggcaucgcuccggaagcacacugggcaaggccuuuuccaccacccucaaaggggcgcagcggcuggccgcucugggagauacagccugggacuucggcucuaucgggggaguguucaauagcauuggcagagcuguccaccaaguguuugggggcgccuuccgcacgcuuuuuggaggcauguccuggaucacccaggggcucaugggagcccugcugcucuggaugggcguuaacgcucgggauagaucuauugcgcuggccuuccuugcuacagggggagugcuggucuuucucgccaccaaugugcaugccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8836 - RNA, 2365 nt, Artificial Sequence; identical to SEQ ID NO: 8813
  ZIKV (strain ZikaSPH2015) Polyprotein(93-804) mRNA Design 3 opt

SEQ ID NO: 8837 - RNA, 2362 nt, Artificial Sequence
  ZIKV prME variant mRNA Design 3 opt
gggagaaagcuuaccaugaucauuaacgccagaaaggagaaaaagcggcgcggcgcugacaccagcguggggaucgucggacugcuccugacaacggccauggcggcugaaguuaccagacggggcuccgccuacuauauguaccuugaucgcaaugacgccggggaggcuauuucuuuccccacaacccugggaaugaacaaaugcuauauccagauuauggaucucggccacaugugugacgccacaaugagcuacgaaugcccuaugcuggaugaggggguggaaccggacgauguggacuguuggugcaauaccacauccaccugggucguguauggaacgugucaucacaagaaaggcgaggcuagacggucucgcagagccguuacccuucccagccauuccacacggaagcugcaaacccgcucucagacauggcucgagagcagagaauacaccaagcaccugauccggguggagaacuggaucuuucgcaauccuggcuucgcgcuggccgcugccgcuauugccuggcuccugggguccagcacgucucagaaagucaucuaucuugugaugauucugcucaucgcgcccgccuacuccauuagaugcaucggaguuagcaaccgggauuuuguggaaggcaugucugggggaacaugggucgacauugugcuggagcauggcgggugugugaccgucauggcucaggauaagccuacaguugacaucgagcuugugaccaccacaguguccaauauggccgaaguccgcagcuacugcuaugaggcuucuaucuccgauauggccagcgacuccagaugucccacgcaaggagaagccuaccuggacaaacagucugauacccaguaugugugcaagcggacacucguugacagaggcuggggcaacggguguggacuguucggcaaagggagccuggugaccugcgcuaaguuugcgugcuccaagaaaaugacaggaaagagcauucagccugagaaucucgaauaccgcaucaugcugucuguccacggcucccaacacagcgggaugauugugaacgauaccggacaugagacggacgagaaucgggccaaaguugaaaucacaccgaacucucccagagcugaggccacccuuggcggcuucgggagccugggacucgauugugaaccucgcaccggccuggacuuuuccgaucuuuauuaccugacaaugaauaacaagcacuggcucgugcauaaagagugguuccacgacauuccccugccuuggcacgccggggcugauaccggaacaccccauuggaauaacaaggaagcccuggucgaguuuaaagacgcgcacgcuaagcggcagacgguggucgugcucggcucucaggagggggccguucauaccgcccuggcuggcgcccuugaagcugagauggauggagccaagggcagacugagcuccgggcaccucaaaugccgccugaagauggacaaacuucggcugaagggagugagcuauucucucuguacagcggccuucaccuuuacaaaaaucccggcugaaacccugcauggcacggucaccguggagguucaguacgccgggacagacggaccuugcaaggugcccgcucaaauggccgucgauaugcagacccugacaccugugggcagacucaucaccgcgaaccccgugauuacggaauccacagagaauagcaagaugaugcuggagcuugaucccccuuucggggacucuuacaucguuauuggcgucggagagaaaaagaucacccaccacuggcaucgcuccggcagcacaauugggaaagccuuugaagcuaccgugcggggagccaagagaauggcugugcugggcgacaccgccugggauuucggguccgucggaggcgcccucaacucucuggggaaaggcauccaccagaucuucggagcugcguuuaagagccuguucggcgggauguccugguuuucucaaauucuuaucggaacacuccugauguggcugggccucaauacgaagaacgggagcauuucccugaugugucuugcccugggaggcgugcucaucuuccugagcaccgcuguuucugccgacguggggugcuccgucgauuuuagcaaaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8838 - RNA, 2359 nt, Artificial Sequence
  ZIKV prME variant mRNA Design 3 opt
gggagaaagcuuaccaugaucaacgccagaaaggagaaaaagcggcgcggcgcugacaccagcguggggauugucggacugcuccugacaacggccauggcggcugaaguuaccagacggggcuccgccuacuauauguaccuugaucgcaaugacgccggggaggcuaucucuuuccccacaacccugggaaugaacaaaugcuauauucagaucauggaucucggccacaugugugacgccacaaugagcuacgaaugcccuaugcuggaugaggggguggaaccggacgauguggacuguuggugcaauaccacauccaccugggucguguauggaacgugucaucacaagaaaggcgaggcuagacggucucgcagagccguuacccuucccagccauuccacacggaagcugcaaacccgcucucagacauggcucgagagcagagaauacaccaagcaccugauucggguggagaacuggaucuuucgcaauccuggcuucgcgcuggccgcugccgcuaucgccuggcuccugggguccagcacgucucagaaagucauuuaucuugugaugauccugcucauugcgcccgccuacuccaucagaugcauuggaguuagcaaccgggauuuuguggaaggcaugucugggggaacaugggucgacaucgugcuggagcauggcgggugugugaccgucauggcucaggauaagccuacaguugacauugagcuugugaccaccacaguguccaauauggccgaaguccgcagcuacugcuaugaggcuucuaucuccgauauggccagcgacuccagaugucccacgcaaggagaagccuaccuggacaaacagucugauacccaguaugugugcaagcggacacucguugacagaggcuggggcaacggguguggacuguucggcaaagggagccuggugaccugcgcuaaguuugcgugcuccaagaaaaugacaggaaagagcauccagccugagaaucucgaauaccgcauuaugcugucuguccacggcucccaacacagcgggaugaucgugaacgauaccggacaugagacggacgagaaucgggccaaaguugaaauuacaccgaacucucccagagcugaggccacccuuggcggcuucgggagccugggacucgauugugaaccucgcaccggccuggacuuuuccgaucuuuauuaccugacaaugaauaacaagcacuggcucgugcauaaagagugguuccacgacaucccccugccuuggcacgccggggcugauaccggaacaccccauuggaauaacaaggaagcccuggucgaguuuaaagacgcgcacgcuaagcggcagacgguggucgugcucggcucucaggagggggccguucauaccgcccuggcuggcgcccuugaagcugagauggauggagccaagggcagacugagcuccgggcaccucaaaugccgccugaagauggacaaacuucggcugaagggagugagcuauucucucuguacagcggccuucaccuuuacaaaaauuccggcugaaacccugcauggcacggucaccguggagguucaguacgccgggacagacggaccuugcaaggugcccgcucaaauggccgucgauaugcagacccugacaccugugggcagacucaucaccgcgaaccccgugaucacggaauccacagagaauagcaagaugaugcuggagcuugaucccccuuucggggacucuuacauuguuaucggcgucggagagaaaaagauuacccaccacuggcaucgcuccggcagcacaaucgggaaagccuuugaagcuaccgugcggggagccaagagaauggcugugcugggcgacaccgccugggauuucggguccgucggaggcgcccucaacucucuggggaaaggcauucaccagaucuucggagcugcguuuaagagccuguucggcgggauguccugguuuucucaaauccuuauuggaacacuccugauguggcugggccucaauacgaagaacgggagcaucucccugaugugucuugcccugggaggcgugcucauuuuccugagcaccgcuguuucugccgacguggggugcuccgucgauuuuagcaaaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8839 - RNA, 2356 nt, Artificial Sequence
  ZIKV prME variant mRNA Design 3 opt
gggagaaagcuuaccaugaacgccagaaaggagaaaaagcggcgcggcgcugacaccagcguggggaucgucggacugcuccugacaacggccauggcggcugaaguuaccagacggggcuccgccuacuauauguaccuugaucgcaaugacgccggggaggcuauuucuuuccccacaacccugggaaugaacaaaugcuauauccagauuauggaucucggccacaugugugacgccacaaugagcuacgaaugcccuaugcuggaugaggggguggaaccggacgauguggacuguuggugcaauaccacauccaccugggucguguauggaacgugucaucacaagaaaggcgaggcuagacggucucgcagagccguuacccuucccagccauuccacacggaagcugcaaacccgcucucagacauggcucgagagcagagaauacaccaagcaccugauccggguggagaacuggauuuuucgcaauccuggcuucgcgcuggccgcugccgcuaucgccuggcuccugggguccagcacgucucagaaagucaucuaucuugugaugauucugcucaucgcgcccgccuacuccauuagaugcaucggaguuagcaaccgggauuuuguggaaggcaugucugggggaacaugggucgacauugugcuggagcauggcgggugugugaccgucauggcucaggauaagccuacaguugacaucgagcuugugaccaccacaguguccaauauggccgaaguccgcagcuacugcuaugaggcuucuauuuccgauauggccagcgacuccagaugucccacgcaaggagaagccuaccuggacaaacagucugauacccaguaugugugcaagcggacacucguugacagaggcuggggcaacggguguggacuguucggcaaagggagccuggugaccugcgcuaaguuugcgugcuccaagaaaaugacaggaaagagcauccagccugagaaucucgaauaccgcaucaugcugucuguccacggcucccaacacagcgggaugauugugaacgauaccggacaugagacggacgagaaucgggccaaaguugaaaucacaccgaacucucccagagcugaggccacccuuggcggcuucgggagccugggacucgauugugaaccucgcaccggccuggacuuuuccgaucuuuauuaccugacaaugaauaacaagcacuggcucgugcauaaagagugguuccacgacauuccccugccuuggcacgccggggcugauaccggaacaccccauuggaauaacaaggaagcccuggucgaguuuaaagacgcgcacgcuaagcggcagacgguggucgugcucggcucucaggagggggccguucauaccgcccuggcuggcgcccuugaagcugagauggauggagccaagggcagacugagcuccgggcaccucaaaugccgccugaagauggacaaacuucggcugaagggagugagcuauucucucuguacagcggccuucaccuuuacaaaaaucccggcugaaacccugcauggcacggucaccguggagguucaguacgccgggacagacggaccuugcaaggugcccgcucaaauggccgucgauaugcagacccugacaccugugggcagacucauuaccgcgaaccccgugaucacggaauccacagagaauagcaagaugaugcuggagcuugaucccccuuucggggacucuuacaucguuauuggcgucggagagaaaaagaucacccaccacuggcaucgcuccggcagcacaauugggaaagccuuugaagcuaccgugcggggagccaagagaauggcugugcugggcgacaccgccugggauuucggguccgucggaggcgcccucaacucucuggggaaaggcauccaccagauuuucggagcugcguuuaagagccuguucggcgggauguccugguuuucucaaauccuuaucggaacacuccugauguggcugggccucaauacgaagaacgggagcauuucccugaugugucuugcccugggaggcgugcucaucuuccugagcaccgcuguuucugccgacguggggugcuccgucgauuuuagcaaaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8840 - RNA, 2353 nt, Artificial Sequence
  ZIKV prME variant mRNA Design 3 opt
gggagaaagcuuaccauggccagaaaggagaaaaagcggcgcggcgcugacaccagcguggggaucgucggacugcuccugacaacggccauggcggcugaaguuaccagacggggcuccgccuacuauauguaccuugaucgcaacgacgccggggaggcuauuucuuuccccacaacccugggaaugaauaaaugcuauauccagauuauggaucucggccacaugugugacgccacaaugagcuacgaaugcccuaugcuggaugaggggguggaaccggacgauguggacuguuggugcaacaccacauccaccugggucguguauggaacgugucaucacaagaaaggcgaggcuagacggucucgcagagccguuacccuucccagccauuccacacggaagcugcaaacccgcucucagacauggcucgagagcagagaauacaccaagcaccugauccggguggagaauuggauuuuucgcaacccuggcuucgcgcuggccgcugccgcuaucgccuggcuccugggguccagcacgucucagaaagucaucuaucuugugaugauucugcucaucgcgcccgccuacuccauuagaugcaucggaguuagcaaucgggauuuuguggaaggcaugucugggggaacaugggucgacauugugcuggagcauggcgggugugugaccgucauggcucaggauaagccuacaguugacaucgagcuugugaccaccacaguguccaacauggccgaaguccgcagcuacugcuaugaggcuucuauuuccgauauggccagcgacuccagaugucccacgcaaggagaagccuaccuggacaaacagucugauacccaguaugugugcaagcggacacucguugacagaggcuggggcaauggguguggacuguucggcaaagggagccuggugaccugcgcuaaguuugcgugcuccaagaaaaugacaggaaagagcauccagccugagaaccucgaauaccgcaucaugcugucuguccacggcucccaacacagcgggaugauugugaaugauaccggacaugagacggacgagaaccgggccaaaguugaaaucacacccaauucucccagagcugaggccacccuuggcggcuucgggagccugggacucgauugugaaccucgcaccggccuggacuuuuccgaucuuuauuaccugacaaugaacaauaagcacuggcucgugcauaaagagugguuccacgacauuccccugccuuggcacgccggggcugauaccggaacaccccauuggaacaauaaggaagcccuggucgaguuuaaagacgcgcacgcuaagcggcagacgguggucgugcucggcucucaggagggggccguucauaccgcccuggcuggcgcccuugaagcugagauggauggagccaagggcagacugagcuccgggcaccucaaaugccgccugaagauggacaaacuucggcugaagggagugagcuauucucucuguacagcggccuucaccuuuacaaaaaucccggcugaaacccugcauggcacggucaccguggagguucaguacgccgggacagacggaccuugcaaggugcccgcucaaauggccgucgauaugcagacccugacaccugugggcagacucauuaccgcgaaccccgugaucacggaauccacagagaacagcaagaugaugcuggagcuugacccgccuuucggggauucuuacaucguuauuggcgucggagagaaaaagaucacccaccacuggcaucgcuccggcagcacaauugggaaagccuuugaagcuaccgugcggggagccaagagaauggcugugcugggcgacaccgccugggauuucggguccgucggaggcgcccucaauucucuggggaaaggcauccaccagauuuucggagcugcguuuaagagccuguucggcgggauguccugguuuucucaaauccuuaucggaacacuccugauguggcugggccucaacacgaagaaugggagcauuucccugaugugucuugcccugggaggcgugcucaucuuccugagcaccgcuguuucugccgacguggggugcuccgucgauuuuagcaaaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8841 - RNA, 2350 nt, Artificial Sequence
  ZIKV prME variant mRNA Design 3 opt
gggagaaagcuuaccaugagaaaggagaaaaagcggcgcggcgccgacaccagcguggggaucgucggacugcuccugacaacggcuauggccgcggaaguuaccagacggggcuccgcuuacuauauguaccuugaucgcaacgacgccggggaggccauuucuuuccccacaacccugggaaugaauaaaugcuauauccagauuauggaucucggccacaugugugacgcuacaaugagcuacgaaugcccuaugcuggaugaggggguggaaccggacgauguggacuguuggugcaacaccacauccaccugggucguguauggaacgugucaucacaagaaaggcgaggccagacggucucgcagagcuguuacccuucccagccauuccacacggaagcugcaaacccgcucucagacauggcucgagagcagagaauacaccaagcaccugauccggguggagaauuggauuuuucgcaacccuggcuucgcccuggcggccgcugccaucgcuuggcuccugggguccagcacgucucagaaagucaucuaucuugugaugauucugcucaucgcccccgcguacuccauuagaugcaucggaguuagcaaucgggauuuuguggaaggcaugucugggggaacaugggucgacauugugcuggagcauggcgggugugugaccgucauggcccaggauaagccuacaguugacaucgagcuugugaccaccacaguguccaacauggcugaaguccgcagcuacugcuaugaggccucuauuuccgauauggcuagcgacuccagaugucccacgcaaggagaagccuaccuggacaaacagucugauacccaguaugugugcaagcggacacucguugacagaggcuggggcaauggguguggacuguucggcaaagggagccuggugaccugcgccaaguuugcuugcuccaagaaaaugacaggaaagagcauccagccugagaaccucgaauaccgcaucaugcugucuguccacggcucccaacacagcgggaugauugugaaugauaccggacaugagacggacgagaaccgggcgaaaguugaaaucacacccaauucucccagagccgaggcuacccuuggcggcuucgggagccugggacucgauugugaaccucgcaccggccuggacuuuuccgaucuuuauuaccugacaaugaacaauaagcacuggcucgugcauaaagagugguuccacgacauuccccugccuuggcacgccggggccgauaccggaacaccccauuggaacaauaaggaagcucuggucgaguuuaaagacgcccacgcgaagcggcagacgguggucgugcucggcucucaggagggggcuguucauaccgcccuggccggcgcucuugaagccgagauggauggagcuaagggcagacugagcuccgggcaccucaaaugccgccugaagauggacaaacuucggcugaagggagugagcuauucucucuguacagccgcguucaccuuuacaaaaaucccggccgaaacccugcauggcacggucaccguggagguucaguacgcugggacagacggaccuugcaaggugcccgcccaaauggcugucgauaugcagacccugacaccugugggcagacucauuaccgccaaccccgugaucacggaauccacagagaacagcaagaugaugcuggagcuugacccgccuuucggggauucuuacaucguuauuggcgucggagagaaaaagaucacccaccacuggcaucgcuccggcagcacaauugggaaagcguuugaagccaccgugcggggagcuaagagaauggccgugcugggcgacaccgcuugggauuucggguccgucggaggcgcccucaauucucuggggaaaggcauccaccagauuuucggagccgcuuuuaagagccuguucggcgggauguccugguuuucucaaauccuuaucggaacacuccugauguggcugggccucaacacgaagaaugggagcauuucccugaugugucuugcgcugggaggcgugcucaucuuccugagcaccgccguuucugcugacguggggugcuccgucgauuuuagcaaaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8842 - RNA, 2347 nt, Artificial Sequence
  ZIKV prME variant mRNA Design 3 opt
gggagaaagcuuaccaugaaggagaaaaagagacggggcgccgacaccagcguggggaucgucggacugcuccugacaacggcuauggccgcggaaguuacccgcagaggcuccgcuuacuauauguaccuugaucggaacgacgccggggaggccauuucuuuccccacaacccugggaaugaauaaaugcuauauccagauuauggaucucggccacaugugugacgcuacaaugagcuacgaaugcccuaugcuggaugaggggguggaaccggacgauguggacuguuggugcaacaccacauccaccugggucguguauggaacgugucaucacaagaaaggcgaggcccgcagaucucggcgcgcuguuacccuucccagccauuccacaagaaagcugcaaacccggucucagacauggcucgagagccgcgaauacaccaagcaccugaucagaguggagaauuggauuuuucggaacccuggcuucgcccuggcggccgcugccaucgcuuggcuccugggguccagcacgucucagaaagucaucuaucuugugaugauucugcucaucgcccccgcguacuccauucgcugcaucggaguuagcaauagagauuuuguggaaggcaugucugggggaacaugggucgacauugugcuggagcauggcgggugugugaccgucauggcccaggauaagccuacaguugacaucgagcuugugaccaccacaguguccaacauggcugaaguccggagcuacugcuaugaggccucuauuuccgauauggcuagcgacucccgcugucccacgcaaggagaagccuaccuggacaaacagucugauacccaguaugugugcaagagaacacucguugaccggggcuggggcaauggguguggacuguucggcaaagggagccuggugaccugcgccaaguuugcuugcuccaagaaaaugacaggaaagagcauccagccugagaaccucgaauacagaaucaugcugucuguccacggcucccaacacagcgggaugauugugaaugauaccggacaugagacggacgagaaccgcgcgaaaguugaaaucacacccaauucuccccgggccgaggcuacccuuggcggcuucgggagccugggacucgauugugaaccuagaaccggccuggacuuuuccgaucuuuauuaccugacaaugaacaauaagcacuggcucgugcauaaagagugguuccacgacauuccccugccuuggcacgccggggccgauaccggaacaccccauuggaacaauaaggaagcucuggucgaguuuaaagacgcccacgcgaagcgccagacgguggucgugcucggcucucaggagggggcuguucauaccgcccuggccggcgcucuugaagccgagauggauggagcuaagggccggcugagcuccgggcaccucaaaugcagacugaagauggacaaacuucgccugaagggagugagcuauucucucuguacagccgcguucaccuuuacaaaaaucccggccgaaacccugcauggcacggucaccguggagguucaguacgcugggacagacggaccuugcaaggugcccgcccaaauggcugucgauaugcagacccugacaccugugggccggcucauuaccgccaaccccgugaucacggaauccacagagaacagcaagaugaugcuggagcuugacccgccuuucggggauucuuacaucguuauuggcgucggagagaaaaagaucacccaccacuggcauagauccggcagcacaauugggaaagcguuugaagccaccgugcgcggagcuaagcggauggccgugcugggcgacaccgcuugggauuucggguccgucggaggcgcccucaauucucuggggaaaggcauccaccagauuuucggagccgcuuuuaagagccuguucggcgggauguccugguuuucucaaauccuuaucggaacacuccugauguggcugggccucaacacgaagaaugggagcauuucccugaugugucuugcgcugggaggcgugcucaucuuccugagcaccgccguuucugcugacguggggugcuccgucgauuuuagcaaaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8843 - RNA, 2344 nt, Artificial Sequence
  ZIKV prME variant mRNA Design 3 opt
gggagaaagcuuaccauggagaagaaaagacggggcgccgacaccagcguggggaucgucggacugcuccugacaacggcuauggccgcggaaguuacccgcagaggcuccgcuuacuauauguaccuugaucggaacgacgccggggaggccauuucuuuccccacaacccugggaaugaauaagugcuauauccagauuauggaucucggccacaugugugacgcuacaaugagcuacgaaugcccuaugcuggaugaggggguggaaccggacgauguggacuguuggugcaacaccacauccaccugggucguguauggaacgugucaucacaaaaagggcgaggcccgcagaucucggcgcgcuguuacccuucccagccauuccacaagaaaacugcaaacccggucucagacauggcucgagagccgcgaauacaccaagcaccugaucagaguggagaauuggauuuuucggaacccuggcuucgcccuggcggccgcugccaucgcuuggcuccugggguccagcacgucucagaaggucaucuaucuugugaugauucugcucaucgcccccgcguacuccauucgcugcaucggaguuagcaauagagauuuuguggaaggcaugucugggggaacaugggucgacauugugcuggagcauggcgggugugugaccgucauggcccaggauaaaccuacaguugacaucgagcuugugaccaccacaguguccaacauggcugaaguccggagcuacugcuaugaggccucuauuuccgauauggcuagcgacucccgcugucccacgcaaggagaagccuaccuggacaagcagucugauacccaguaugugugcaaaagaacacucguugaccggggcuggggcaauggguguggacuguucggcaaggggagccuggugaccugcgccaaauuugcuugcuccaagaagaugacaggaaaaagcauccagccugagaaccucgaauacagaaucaugcugucuguccacggcucccaacacagcgggaugauugugaaugauaccggacaugagacggacgagaaccgcgcgaagguugaaaucacacccaauucuccccgggccgaggcuacccuuggcggcuucgggagccugggacucgauugugaaccuagaaccggccuggacuuuuccgaucuuuauuaccugacaaugaacaauaaacacuggcucgugcauaaggagugguuccacgacauuccccugccuuggcacgccggggccgauaccggaacaccccauuggaacaauaaagaagcucuggucgaguuuaaggacgcccacgcgaaacgccagacgguggucgugcucggcucucaggagggggcuguucauaccgcccuggccggcgcucuugaagccgagauggauggagcuaagggccggcugagcuccgggcaccucaagugcagacugaaaauggacaaacuucgccugaagggagugagcuauucucucuguacagccgcguucaccuuuacaaagaucccggccgaaacccugcauggcacggucaccguggagguucaguacgcugggacagacggaccuugcaaagugcccgcccaaauggcugucgauaugcagacccugacaccugugggccggcucauuaccgccaaccccgugaucacggaauccacagagaacagcaagaugaugcuggagcuugacccgccuuucggggauucuuacaucguuauuggcgucggagaaaagaaaaucacccaccacuggcauagauccggcagcacaauugggaaggcguuugaggccaccgugcgcggagcuaaacggauggccgugcugggcgacaccgcuugggauuucggguccgucggaggcgcccucaauucucuggggaagggcauccaccagauuuucggagccgcuuuuaaaagccuguucggcgggauguccugguuuucucaaauccuuaucggaacacuccugauguggcugggccucaacacgaagaaugggagcauuucccugaugugucuugcgcugggaggcgugcucaucuuccugagcaccgccguuucugcugacguggggugcuccgucgauuuuagcaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8844 - RNA, 2341 nt, Artificial Sequence
  ZIKV prME variant mRNA Design 3 opt
gggagaaagcuuaccaugaagaaaagacggggcgccgacaccagcguggggaucgucggacugcuccugacaacggcuauggccgcggagguuacccgcagaggcuccgcuuacuauauguaccuugaucggaacgacgccggggaagccauuucuuuccccacaacccugggaaugaauaagugcuauauccagauuauggaucucggccacaugugugacgcuacaaugagcuacgagugcccuaugcuggaugaagggguggagccggacgauguggacuguuggugcaacaccacauccaccugggucguguauggaacgugucaucacaaaaagggcgaagcccgcagaucucggcgcgcuguuacccuucccagccauuccacaagaaaacugcaaacccggucucagacauggcucgagagccgcgaguacaccaagcaccugaucagaguggaaaauuggauuuuucggaacccuggcuucgcccuggcggccgcugccaucgcuuggcuccugggguccagcacgucucagaaggucaucuaucuugugaugauucugcucaucgcccccgcguacuccauucgcugcaucggaguuagcaauagagauuuuguggagggcaugucugggggaacaugggucgacauugugcuggaacauggcgggugugugaccgucauggcccaggauaaaccuacaguugacaucgagcuugugaccaccacaguguccaacauggcugagguccggagcuacugcuaugaagccucuauuuccgauauggcuagcgacucccgcugucccacgcaaggagaggccuaccuggacaagcagucugauacccaguaugugugcaaaagaacacucguugaccggggcuggggcaauggguguggacuguucggcaaggggagccuggugaccugcgccaaauuugcuugcuccaagaagaugacaggaaaaagcauccagccugaaaaccucgaguacagaaucaugcugucuguccacggcucccaacacagcgggaugauugugaaugauaccggacaugaaacggacgagaaccgcgcgaagguugagaucacacccaauucuccccgggccgaagcuacccuuggcggcuucgggagccugggacucgauugugagccuagaaccggccuggacuuuuccgaucuuuauuaccugacaaugaacaauaaacacuggcucgugcauaaggaaugguuccacgacauuccccugccuuggcacgccggggccgauaccggaacaccccauuggaacaauaaagaggcucuggucgaauuuaaggacgcccacgcgaaacgccagacgguggucgugcucggcucucaggagggggcuguucauaccgcccuggccggcgcucuugaggccgaaauggauggagcuaagggccggcugagcuccgggcaccucaagugcagacugaaaauggacaaacuucgccugaagggagugagcuauucucucuguacagccgcguucaccuuuacaaagaucccggccgagacccugcauggcacggucaccguggaaguucaguacgcugggacagacggaccuugcaaagugcccgcccaaauggcugucgauaugcagacccugacaccugugggccggcucauuaccgccaaccccgugaucacggaguccacagaaaacagcaagaugaugcuggagcuugacccgccuuucggggauucuuacaucguuauuggcgucggagagaagaaaaucacccaccacuggcauagauccggcagcacaauugggaaggcguuugaagccaccgugcgcggagcuaaacggauggccgugcugggcgacaccgcuugggauuucggguccgucggaggcgcccucaauucucuggggaagggcauccaccagauuuucggagccgcuuuuaaaagccuguucggcgggauguccugguuuucucaaauccuuaucggaacacuccugauguggcugggccucaacacgaagaaugggagcauuucccugaugugucuugcgcugggaggcgugcucaucuuccugagcaccgccguuucugcugacguggggugcuccgucgauuuuagcaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8845 - RNA, 2338 nt, Artificial Sequence
  ZIKV prME variant mRNA Design 3 opt
gggagaaagcuuaccaugaagagacggggcgccgacaccagcguggggaucgucggacugcuccugacaacggcuauggccgcggagguuacccgcagaggcuccgcuuacuauauguaccuugaucggaacgacgccggggaagccauuucuuuccccacaacccugggaaugaauaaaugcuauauccagauuauggaucucggccacaugugugacgcuacaaugagcuacgagugcccuaugcuggaugaagggguggagccggacgauguggacuguuggugcaacaccacauccaccugggucguguauggaacgugucaucacaagaaaggcgaagcccgcagaucucggcgcgcuguuacccuucccagccauuccacaagaaagcugcaaacccggucucagacauggcucgagagccgcgaguacaccaaacaccugaucagaguggaaaauuggauuuuucggaacccuggcuucgcccuggcggccgcugccaucgcuuggcuccugggguccagcacgucucagaaggucaucuaucuugugaugauucugcucaucgcccccgcguacuccauucgcugcaucggaguuagcaauagagauuuuguggagggcaugucugggggaacaugggucgacauugugcuggaacauggcgggugugugaccgucauggcccaggauaagccuacaguugacaucgagcuugugaccaccacaguguccaacauggcugagguccggagcuacugcuaugaagccucuauuuccgauauggcuagcgacucccgcugucccacgcaaggagaggccuaccuggacaaacagucugauacccaguaugugugcaagagaacacucguugaccggggcuggggcaauggguguggacuguucggcaaagggagccuggugaccugcgccaaguuugcuugcuccaaaaagaugacaggaaagagcauccagccugaaaaccucgaguacagaaucaugcugucuguccacggcucccaacacagcgggaugauugugaaugauaccggacaugaaacggacgagaaccgcgcgaaaguugagaucacacccaauucuccccgggccgaagcuacccuuggcggcuucgggagccugggacucgauugugagccuagaaccggccuggacuuuuccgaucuuuauuaccugacaaugaacaauaagcacuggcucgugcauaaagaaugguuccacgacauuccccugccuuggcacgccggggccgauaccggaacaccccauuggaacaauaaggaggcucuggucgaauuuaaagacgcccacgcgaagcgccagacgguggucgugcucggcucucaggagggggcuguucauaccgcccuggccggcgcucuugaggccgaaauggauggagcuaaaggccggcugagcuccgggcaccucaagugcagacugaagauggacaaacuucgccugaagggagugagcuauucucucuguacagccgcguucaccuuuacaaaaaucccggccgagacccugcauggcacggucaccguggaaguucaguacgcugggacagacggaccuugcaaggugcccgcccaaauggcugucgauaugcagacccugacaccugugggccggcucauuaccgccaaccccgugaucacggaguccacagaaaacagcaaaaugaugcuggagcuugacccgccuuucggggauucuuacaucguuauuggcgucggagagaagaagaucacccaccacuggcauagauccggcagcacaauugggaaagcguuugaagccaccgugcgcggagcuaagcggauggccgugcugggcgacaccgcuugggauuucggguccgucggaggcgcccucaauucucuggggaaaggcauccaccagauuuucggagccgcuuuuaagagccuguucggcgggauguccugguuuucucaaauccuuaucggaacacuccugauguggcugggccucaacacgaaaaaugggagcauuucccugaugugucuugcgcugggaggcgugcucaucuuccugagcaccgccguuucugcugacguggggugcuccgucgauuuuagcaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8846 - RNA, 2335 nt, Artificial Sequence
  ZIKV prME variant mRNA Design 3 opt
gggagaaagcuuaccaugagacggggcgccgacaccagcguggggaucgucggacugcuccugacaacggcuauggccgcggagguuacccgcagaggcuccgcuuacuauauguaccuugaucggaacgacgccggggaagccauuucuuuccccacaacccugggaaugaauaagugcuauauccagauuauggaucucggccacaugugugacgcuacaaugagcuacgagugcccuaugcuggaugaagggguggagccggacgauguggacuguuggugcaacaccacauccaccugggucguguauggaacgugucaucacaaaaagggcgaagcccgcagaucucggcgcgcuguuacccuucccagccauuccacaagaaaacugcaaacccggucucagacauggcucgagagccgcgaguacaccaagcaccugaucagaguggaaaauuggauuuuucggaacccuggcuucgcccuggcggccgcugccaucgcuuggcuccugggguccagcacgucucagaaagucaucuaucuugugaugauucugcucaucgcccccgcguacuccauucgcugcaucggaguuagcaauagagauuuuguggagggcaugucugggggaacaugggucgacauugugcuggaacauggcgggugugugaccgucauggcccaggauaagccuacaguugacaucgagcuugugaccaccacaguguccaacauggcugagguccggagcuacugcuaugaagccucuauuuccgauauggcuagcgacucccgcugucccacgcaaggagaggccuaccuggacaagcagucugauacccaguaugugugcaaaagaacacucguugaccggggcuggggcaauggguguggacuguucggcaaggggagccuggugaccugcgccaaauuugcuugcuccaagaaaaugacaggaaagagcauccagccugaaaaccucgaguacagaaucaugcugucuguccacggcucccaacacagcgggaugauugugaaugauaccggacaugaaacggacgagaaccgcgcgaagguugagaucacacccaauucuccccgggccgaagcuacccuuggcggcuucgggagccugggacucgauugugagccuagaaccggccuggacuuuuccgaucuuuauuaccugacaaugaacaauaaacacuggcucgugcauaaggaaugguuccacgacauuccccugccuuggcacgccggggccgauaccggaacaccccauuggaacaauaaagaggcucuggucgaauuuaaggacgcccacgcgaaacgccagacgguggucgugcucggcucucaggagggggcuguucauaccgcccuggccggcgcucuugaggccgaaauggauggagcuaagggccggcugagcuccgggcaccucaaaugcagacugaagauggacaaacuucgccugaagggagugagcuauucucucuguacagccgcguucaccuuuacaaagaucccggccgagacccugcauggcacggucaccguggaaguucaguacgcugggacagacggaccuugcaaagugcccgcccaaauggcugucgauaugcagacccugacaccugugggccggcucauuaccgccaaccccgugaucacggaguccacagaaaacagcaagaugaugcuggagcuugacccgccuuucggggauucuuacaucguuauuggcgucggagagaaaaagaucacccaccacuggcauagauccggcagcacaauugggaaggcguuugaagccaccgugcgcggagcuaaacggauggccgugcugggcgacaccgcuugggauuucggguccgucggaggcgcccucaauucucuggggaagggcauccaccagauuuucggagccgcuuuuaaaagccuguucggcgggauguccugguuuucucaaauccuuaucggaacacuccugauguggcugggccucaacacgaagaaugggagcauuucccugaugugucuugcgcugggaggcgugcucaucuuccugagcaccgccguuucugcugacguggggugcuccgucgauuuuagcaaaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8847 - RNA, 2332 nt, Artificial Sequence
  ZIKV prME variant mRNA Design 3 opt
gggagaaagcuuaccaugagaggcgccgacaccagcguggggaucgucggacugcuccugacaacggcuauggccgcggagguuacccggcgcggcuccgcuuacuauauguaccuugauagaaacgacgccggggaagccauuucuuuccccacaacccugggaaugaauaagugcuauauccagauuauggaucucggccacaugugugacgcuacaaugagcuacgagugcccuaugcuggaugaagggguggagccggacgauguggacuguuggugcaacaccacauccaccugggucguguauggaacgugucaucacaaaaagggcgaagcccggcgcucuagacgggcuguuacccuucccagccauuccacacgcaaacugcaaaccagaucucagacauggcucgagagccgggaguacaccaagcaccugauccgcguggaaaauuggauuuuuagaaacccuggcuucgcccuggcggccgcugccaucgcuuggcuccugggguccagcacgucucagaaagucaucuaucuugugaugauucugcucaucgcccccgcguacuccauucggugcaucggaguuagcaaucgcgauuuuguggagggcaugucugggggaacaugggucgacauugugcuggaacauggcgggugugugaccgucauggcccaggauaagccuacaguugacaucgagcuugugaccaccacaguguccaacauggcugaggucagaagcuacugcuaugaagccucuauuuccgauauggcuagcgacucccggugucccacgcaaggagaggccuaccuggacaagcagucugauacccaguaugugugcaaacgcacacucguugacagaggcuggggcaauggguguggacuguucggcaaggggagccuggugaccugcgccaaauuugcuugcuccaagaaaaugacaggaaagagcauccagccugaaaaccucgaguaccggaucaugcugucuguccacggcucccaacacagcgggaugauugugaaugauaccggacaugaaacggacgagaacagagcgaagguugagaucacacccaauucuccccgcgccgaagcuacccuuggcggcuucgggagccugggacucgauugugagccucggaccggccuggacuuuuccgaucuuuauuaccugacaaugaacaauaaacacuggcucgugcauaaggaaugguuccacgacauuccccugccuuggcacgccggggccgauaccggaacaccccauuggaacaauaaagaggcucuggucgaauuuaaggacgcccacgcgaaaagacagacgguggucgugcucggcucucaggagggggcuguucauaccgcccuggccggcgcucuugaggccgaaauggauggagcuaagggccgccugagcuccgggcaccucaaaugccggcugaagauggacaaacuuagacugaagggagugagcuauucucucuguacagccgcguucaccuuuacaaagaucccggccgagacccugcauggcacggucaccguggaaguucaguacgcugggacagacggaccuugcaaagugcccgcccaaauggcugucgauaugcagacccugacaccugugggccgccucauuaccgccaaccccgugaucacggaguccacagaaaacagcaagaugaugcuggagcuugacccgccuuucggggauucuuacaucguuauuggcgucggagagaaaaagaucacccaccacuggcaucgguccggcagcacaauugggaaggcguuugaagccaccgugagaggagcuaaacgcauggccgugcugggcgacaccgcuugggauuucggguccgucggaggcgcccucaauucucuggggaagggcauccaccagauuuucggagccgcuuuuaaaagccuguucggcgggauguccugguuuucucaaauccuuaucggaacacuccugauguggcugggccucaacacgaagaaugggagcauuucccugaugugucuugcgcugggaggcgugcucaucuuccugagcaccgccguuucugcugacguggggugcuccgucgauuuuagcaaaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8848 - RNA, 2329 nt, Artificial Sequence
  ZIKV prME variant mRNA Design 3 opt
gggagaaagcuuaccaugggcgccgacaccagcguggggaucgucggacugcuccugacaacggcuauggccgcggagguuaccagacggggcuccgcuuacuauauguaccuugaucgcaacgacgccggggaagccauuucuuuccccacaacccugggaaugaauaagugcuauauccagauuauggaucucggccacaugugugacgcuacaaugagcuacgagugcccuaugcuggaugaagggguggagccggacgauguggacuguuggugcaacaccacauccaccugggucguguauggaacgugucaucacaaaaagggcgaagccagacggucucgcagagcuguuacccuucccagccauuccacacggaaacugcaaacccgcucucagacauggcucgagagcagagaguacaccaagcaccugauccggguggaaaauuggauuuuucgcaacccuggcuucgcccuggcggccgcugccaucgcuuggcuccugggguccagcacgucucagaaagucaucuaucuugugaugauucugcucaucgcccccgcguacuccauuagaugcaucggaguuagcaaucgggauuuuguggagggcaugucugggggaacaugggucgacauugugcuggaacauggcgggugugugaccgucauggcccaggauaagccuacaguugacaucgagcuugugaccaccacaguguccaacauggcugagguccgcagcuacugcuaugaagccucuauuuccgauauggcuagcgacuccagaugucccacgcaaggagaggccuaccuggacaagcagucugauacccaguaugugugcaaacggacacucguugaccgcggcuggggcaauggguguggacuguucggcaaggggagccuggugaccugcgccaaauuugcuugcuccaagaaaaugacaggaaagagcauccagccugaaaaccucgaguacagaaucaugcugucuguccacggcucccaacacagcgggaugauugugaaugauaccggacaugaaacggacgagaaccgggcgaagguugagaucacacccaauucucccagagccgaagcuacccuuggcggcuucgggagccugggacucgauugugagccucgcaccggccuggacuuuuccgaucuuuauuaccugacaaugaacaauaaacacuggcucgugcauaaggaaugguuccacgacauuccccugccuuggcacgccggggccgauaccggaacaccccauuggaacaauaaagaggcucuggucgaauuuaaggacgcccacgcgaaacggcagacgguggucgugcucggcucucaggagggggcuguucauaccgcccuggccggcgcucuugaggccgaaauggauggagcuaagggcagacugagcuccgggcaccucaaaugccgccugaagauggacaaacuucggcugaagggagugagcuauucucucuguacagccgcguucaccuuuacaaagaucccggccgagacccugcauggcacggucaccguggaaguucaguacgcugggacagacggaccuugcaaagugcccgcccaaauggcugucgauaugcagacccugacaccugugggcagacucauuaccgccaaccccgugaucacggaguccacagaaaacagcaagaugaugcuggagcuugacccgccuuucggggauucuuacaucguuauuggcgucggagagaaaaagaucacccaccacuggcaucgcuccggcagcacaauugggaaggcguuugaagccaccgugcggggagcuaaaagaauggccgugcugggcgacaccgcuugggauuucggguccgucggaggcgcccucaauucucuggggaagggcauccaccagauuuucggagccgcuuuuaaaagccuguucggcgggauguccugguuuucucaaauccuuaucggaacacuccugauguggcugggccucaacacgaagaaugggagcauuucccugaugugucuugcgcugggaggcgugcucaucuuccugagcaccgccguuucugcugacguggggugcuccgucgauuuuagcaaaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8849 - RNA, 2326 nt, Artificial Sequence
  ZIKV prME variant mRNA Design 3 opt
gggagaaagcuuaccauggccgacaccagcgugggcaucgucgggcugcuccugacaacggcuauggccgcggagguuaccagacggggauccgcuuacuauauguaccuugaucgcaacgacgccggcgaagccauuucuuuccccacaacccuggggaugaauaagugcuauauccagauuauggaucucggacacaugugugacgcuacaaugagcuacgagugcccuaugcuggaugaaggcguggagccggacgauguggacuguuggugcaacaccacauccaccugggucguguaugggacgugucaucacaaaaagggagaagccagacggucucgcagagcuguuacccuucccagccauuccacacggaaacugcaaacccgcucucagacauggcucgagagcagagaguacaccaagcaccugauccggguggaaaauuggauuuuucgcaacccuggcuucgcccuggcggccgcugccaucgcuuggcuccugggcuccagcacgucucagaaagucaucuaucuugugaugauucugcucaucgcccccgcguacuccauuagaugcaucgggguuagcaaucgggauuuuguggagggaaugucuggcgggacaugggucgacauugugcuggaacauggaggcugugugaccgucauggcccaggauaagccuacaguugacaucgagcuugugaccaccacaguguccaacauggcugagguccgcagcuacugcuaugaagccucuauuuccgauauggcuagcgacuccagaugucccacgcaaggggaggccuaccuggacaagcagucugauacccaguaugugugcaaacggacacucguugaccgcggauggggcaauggcugugggcuguucggaaagggcagccuggugaccugcgccaaauuugcuugcuccaagaaaaugacaggaaagagcauccagccugaaaaccucgaguacagaaucaugcugucuguccacgggucccaacacagcggcaugauugugaaugauaccgggcaugaaacggacgagaaccgggcgaagguugagaucacacccaauucucccagagccgaagcuacccuuggaggcuucggcagccuggggcucgauugugagccucgcaccggacuggacuuuuccgaucuuuauuaccugacaaugaacaauaaacacuggcucgugcauaaggaaugguuccacgacauuccccugccuuggcacgccggcgccgauaccgggacaccccauuggaacaauaaagaggcucuggucgaauuuaaggacgcccacgcgaaacggcagacgguggucgugcucggaucucaggagggcgcuguucauaccgcccuggccggggcucuugaggccgaaauggauggcgcuaagggaagacugagcuccggccaccucaaaugccgccugaagauggacaagcugcggcugaaaggggugagcuauucucucuguacagccgcguucaccuuuacaaagaucccggccgagacccugcauggaacggucaccguggaaguucaguacgcuggcacagacgggccuugcaaagugcccgcccaaauggcugucgauaugcagacccugacaccugugggaagacucauuaccgccaaccccgugaucacggaguccacagaaaacagcaagaugaugcuggagcuugacccgccuuucggcgauucuuacaucguuauuggggucggcgagaaaaagaucacccaccacuggcaucgcuccggaagcacaauuggcaaggcguuugaagccaccgugagaggggcuaaacggauggccgugcugggagacaccgcuugggauuucggcuccgucgggggagcccucaauucucugggcaaggggauccaccagauuuucggcgccgcuuuuaaaagccuguucggaggcauguccugguuuucucaaauccuuaucgggacacuccugauguggcugggacucaacacgaagaauggcagcauuucccugaugugucuugcgcuugggggagugcucaucuuccugagcaccgccguuucugcugacgugggcugcuccgucgauuuuagcaaaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8850 - RNA, 2323 nt, Artificial Sequence
  ZIKV prME variant mRNA Design 3 opt
gggagaaagcuuaccauggacaccagcgugggcaucgucgggcugcuccugacaacggccauggcugccgagguuaccagacggggauccgcguacuauauguaccuugaucgcaacgacgcuggcgaagccauuucuuuccccacaacccuggggaugaauaagugcuauauccagauuauggaucucggacacaugugugacgccacaaugagcuacgagugcccuaugcuggaugaaggcguggagccggacgauguggacuguuggugcaacaccacauccaccugggucguguaugggacgugucaucacaaaaagggagaagcuagacggucucgcagagccguuacccuucccagccauuccacacggaaacugcaaacccgcucucagacauggcucgagagcagagaguacaccaagcaccugauccggguggaaaauuggauuuuucgcaacccuggcuucgcucuggccgcggccgcuaucgccuggcuccugggcuccagcacgucucagaaagucaucuaucuugugaugauucugcucaucgcucccgccuacuccauuagaugcaucgggguuagcaaucgggauuuuguggagggaaugucuggcgggacaugggucgacauugugcuggaacauggaggcugugugaccgucauggcgcaggauaagccuacaguugacaucgagcuugugaccaccacaguguccaacauggccgagguccgcagcuacugcuaugaagcuagcauuuccgauauggccagcgacuccagaugucccacgcaaggggaggcuuaccuggacaagcagucugauacccaguaugugugcaaacggacacucguugaccgcggauggggcaauggcugugggcuguucggaaagggcagccuggugaccugcgccaaauuugccugcuccaagaaaaugacagggaagucuauccagccugaaaaccucgaguacagaaucaugcugucuguccacggaucccaacacagcggcaugauugugaaugauaccgggcaugaaacggacgagaaccgggcuaagguugagaucacacccaauucucccagagcggaagccacccuuggaggcuucggcagccuggggcucgauugugagccucgcaccggacuggacuuuuccgaucuuuauuaccugacaaugaacaauaaacacuggcucgugcauaaggaaugguuccacgacauuccccugccuuggcacgcuggcgccgauaccgggacaccccauuggaacaauaaagaggcccuggucgaauuuaaggacgcucacgccaaacggcagacgguggucgugcucggaucucaggagggcgcgguucauaccgcucuggccggggcccuugaggcugaaauggauggcgccaagggaagacugagcuccggccaccucaaaugccgccugaagauggacaagcugcggcugaaaggggugagcuauucucucuguacagcugccuucaccuuuacaaagaucccggcggagacccugcauggaacggucaccguggaaguucaguacgccggcacagacgggccuugcaaagugcccgcucaaauggccgucgauaugcagacccugacaccugugggaagacucauuaccgcuaaccccgugaucacggaguccacagaaaacagcaagaugaugcuggagcuugacccgccuuucggcgauucuuacaucguuauuggggucggcgagaaaaagaucacccaccacuggcaucgcuccggaagcacaauuggcaaggccuuugaagcgaccgugagaggggccaaacggauggcugugcugggagacaccgccugggauuucggcuccgucgggggagcucucaauucucugggcaaggggauccaccagauuuucggcgccgccuuuaaaagccuguucggaggcauguccugguuuucucaaauccuuaucgggacacuccugauguggcugggacucaacacgaagaauggcagcauuucccugaugugucuugcucuugggggagugcucaucuuccugagcaccgcgguuucugccgacgugggcugcuccgucgauuuuagcaaaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8851 - RNA, 2320 nt, Artificial Sequence
  ZIKV prME variant mRNA Design 3 opt
gggagaaagcuuaccaugaccagcgugggcaucgucgggcugcuccugacaacggccauggcugccgagguuaccagacggggauccgcguacuauauguaccuugaccgcaacgaugcuggcgaagccauuucuuuccccacaacccuggggaugaauaagugcuauauccagauuauggaccucggacacaugugugaugccacaaugagcuacgagugcccuaugcuggacgaaggcguggagccggaugacguggauuguuggugcaacaccacauccaccugggucguguaugggacgugucaucacaaaaagggagaagcuagacggucucgcagagccguuacccuucccagccauuccacacggaaacugcaaacccgcucucagacauggcucgagagcagagaguacaccaagcaccugauccggguggaaaauuggauuuuucgcaacccuggcuucgcucuggccgcggccgcuaucgccuggcuccugggcuccagcacgucucagaaagucaucuaucuugugaugauucugcucaucgcucccgccuacuccauuagaugcaucgggguuagcaaucgggacuuuguggagggaaugucuggcgggacaugggucgauauugugcuggaacauggaggcugugugaccgucauggcgcaggacaagccuacaguugauaucgagcuugugaccaccacaguguccaacauggccgagguccgcagcuacugcuaugaagcuagcauuuccgacauggccagcgauuccagaugucccacgcaaggggaggcuuaccuggacaagcagucugacacccaguaugugugcaaacggacacucguugaucgcggauggggcaauggcugugggcuguucggaaagggcagccuggugaccugcgccaaauuugccugcuccaagaaaaugacagggaagucuauccagccugaaaaccucgaguacagaaucaugcugucuguccacggaucccaacacagcggcaugauugugaaugacaccgggcaugaaacggaugagaaccgggcuaagguugagaucacacccaauucuccgagagcggaagccacccuuggaggcuucggcagccuggggcucgacugugagccucgcaccggacuggauuuuuccgaccuuuauuaccugacaaugaacaauaaacacuggcucgugcauaaggaaugguuccacgauauuccccugccuuggcacgcuggcgccgacaccgggacaccccauuggaacaauaaagaggcccuggucgaauuuaaggaugcucacgccaaacggcagacgguggucgugcucggaucucaggagggcgcgguucauaccgcucuggccggggcccuugaggcugaaauggacggcgccaagggaagacugagcuccggccaccucaaaugccgccugaagauggauaagcugcggcugaaaggggugagcuauucucucuguacagcugccuucaccuuuacaaagaucccggcggagacccugcauggaacggucaccguggaaguucaguacgccggcacagacgggccuugcaaagugcccgcucaaauggccgucgacaugcagacccugacaccugugggaagacucauuaccgcuaaccccgugaucacggaguccacagaaaacagcaagaugaugcuggagcuugaucccccuuucggcgacucuuacaucguuauuggggucggcgagaaaaagaucacccaccacuggcaucgcuccggaagcacaauuggcaaggccuuugaagcgaccgugagaggggccaaacggauggcugugcugggagauaccgccugggacuucggcuccgucgggggagcucucaauucucugggcaaggggauccaccagauuuucggcgccgccuuuaaaagccuguucggaggcauguccugguuuucucaaauccuuaucgggacacuccugauguggcugggacucaacacgaagaauggcagcauuucccugaugugucuugcucuugggggagugcucaucuuccugagcaccgcgguuucugccgaugugggcugcuccgucgacuuuagcaaaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8852 - RNA, 2320 nt, Artificial Sequence
  ZIKV prME variant mRNA Design 3 opt
gggagaaagcuuaccaugaccagcgugggcaucgucgggcugcuccugacaacggccauggcugccgcgguuaccagacggggauccgcuuacuauauguaccuugaccgcaacgaugccggcgaggccauuucuuuccccacaacccuggggaugaauaagugcuauauccagauuauggaccucggacacaugugugaugcuacaaugagcuacgaaugcccuaugcuggacgagggcguggaaccggaugacguggauuguuggugcaacaccacauccaccugggucguguaugggacgugucaucacaaaaagggagaggccagacggucucgcagagcuguuacccuucccagccauuccacacggaaacugcaaacccgcucucagacauggcucgaaagcagagaguacaccaagcaccugauccggguggagaauuggauuuuucgcaacccuggcuucgcccuggcggccgcugccaucgcuuggcuccugggcuccagcacgucucagaaagucaucuaucuugugaugauucugcucaucgcccccgcguacuccauuagaugcaucgggguuagcaaucgggacuuuguggaaggaaugucuggcgggacaugggucgauauugugcuggagcauggaggcugugugaccgucauggcccaggacaagccuacaguugauaucgaacuugugaccaccacaguguccaacauggcugagguccgcagcuacugcuaugaggccucuauuuccgacauggcuagcgauuccagaugucccacgcaaggggaagccuaccuggacaagcagucugacacccaguaugugugcaaacggacacucguugaucgcggauggggcaauggcugugggcuguucggaaagggcagccuggugaccugcgccaaauuugcuugcuccaagaaaaugacagggaagucuauccagccugagaaccucgaauacagaaucaugcugucuguccacggaucccaacacagcggcaugauugugaaugacaccgggcaugagacggaugaaaaccgggcgaagguugagaucacaccgaauagccccagagccgaggcuacccuuggaggcuucggcagccuggggcucgacugugaaccucgcaccggacuggauuuuuccgaccuuuauuaccugacaaugaacaauaaacacuggcucgugcauaaggagugguuccacgauauuccccugccuuggcacgccggcgccgacaccgggacaccccauuggaacaauaaagaagcucuggucgaguuuaaggaugcccacgcgaaacggcagacgguggucgugcucggaucucaggaaggcgcuguucauaccgcccuggccggggcucuugaggccgagauggacggcgcuaagggaagacugagcuccggccaccucaaaugccgccugaagauggauaagcugcggcugaaaggggugagcuauucucucuguacagccgcguucaccuuuacaaagaucccggccgaaacccugcauggaacggucaccguggagguucaguacgcuggcacagacgggccuugcaaagugcccgcccaaauggcugucgacaugcagacccugacaccugugggaagacucauuaccgccaaccccgugaucacggaauccacagagaacagcaagaugaugcuggaacuugaucccccuuucggcgacucuuacaucguuauuggggucggcgagaaaaagaucacccaccacuggcaucgcuccggaagcacaauuggcaaggcguuugaggccaccgugagaggggcuaaacggauggccgugcugggagauaccgcuugggacuucggcuccgucgggggagcccucaauucucugggcaaggggauccaccagauuuucggcgccgcuuuuaaaagccuguucggaggcauguccugguuuucucaaauccuuaucgggacacuccugauguggcugggacucaacacgaagaauggcagcauuucccugaugugucuugcgcuugggggagugcucaucuuccugagcaccgccguuucugcugaugugggcugcuccgucgacuuuagcaaaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8853 - RNA, 2332 nt, Artificial Sequence
  ZIKV prME variant mRNA Design 3 opt
gggagaaagcuuaccaugagaggcgccgacaccagcguggggaucgucggacugcuccugacaacggcuauggccgcggcuguuacccggcgcggcuccgccuacuauauguaccuugauagaaacgacgccggggaggcuauuucuuuccccacaacccugggaaugaauaagugcuauauccagauuauggaucucggccacaugugugacgccacaaugagcuacgaaugcccuaugcuggaugaggggguggaaccggacgauguggacuguuggugcaacaccacauccaccugggucguguauggaacgugucaucacaaaaagggcgaggcucggcgcucuagacgggccguuacccuucccagccauuccacacgcaaacugcaaaccagaucucagacauggcucgaaagccgggaguacaccaagcaccugauccgcguggagaauuggauuuuuagaaacccuggcuucgcgcuggccgcugccgcuaucgccuggcuccugggguccagcacgucucagaaagucaucuaucuugugaugauucugcucaucgcgcccgccuacuccauucggugcaucggaguuagcaaucgcgauuuuguggaaggcaugucugggggaacaugggucgacauugugcuggagcauggcgggugugugaccgucauggcucaggauaagccuacaguugacaucgaacuugugaccaccacaguguccaacauggccgaggucagaagcuacugcuaugaggcuucuauuuccgauauggccagcgacucccggugucccacgcaaggagaagccuaccuggacaagcagucugauacccaguaugugugcaaacgcacacucguugacagaggcuggggcaauggguguggacuguucggcaaggggagccuggugaccugcgcuaaauuugcgugcuccaagaaaaugacaggaaagagcauccagccugagaaccucgaauaccggaucaugcugucuguccacggcucccaacacagcgggaugauugugaaugauaccggacaugagacggacgaaaacagagccaagguugagaucacacccaauucuccccgcgcugaggccacccuuggcggcuucgggagccugggacucgauugugaaccucggaccggccuggacuuuuccgaucuuuauuaccugacaaugaacaauaaacacuggcucgugcauaaggagugguuccacgacauuccccugccuuggcacgccggggcugauaccggaacaccccauuggaacaauaaagaagcccuggucgaguuuaaggacgcgcacgcuaaaagacagacgguggucgugcucggcucucaggaaggggccguucauaccgcccuggcuggcgcccuugaggcugagauggauggagccaagggccgccugagcuccgggcaccucaaaugccggcugaagauggacaaacuuagacugaagggagugagcuauucucucuguacagcggccuucaccuuuacaaagaucccggcugaaacccugcauggcacggucaccguggagguucaguacgccgggacagacggaccuugcaaagugcccgcucaaauggccgucgauaugcagacccugacaccugugggccgccucauuaccgcgaaccccgugaucacggaauccacagagaacagcaagaugaugcuggaacuugacccgccuuucggggauucuuacaucguuauuggcgucggagagaaaaagaucacccaccacuggcaucgguccggcagcacaauugggaaggccuuugaggcuaccgugagaggagccaaacgcauggcugugcugggcgacaccgccugggauuucggguccgucggaggcgcccucaauucucuggggaagggcauccaccagauuuucggagcugcguuuaaaagccuguucggcgggauguccugguuuucucaaauccuuaucggaacacuccugauguggcugggccucaacacgaagaaugggagcauuucccugaugugucuugcccugggaggcgugcucaucuuccugagcaccgcuguuucugccgacguggggugcuccgucgauuuuagcaaaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8854 - RNA, 2356 nt, Artificial Sequence
  ZIKV prME variant mRNA Design 3 opt
gggagaaagcuuaccaugagaggccugagcucccggaagcgcagaucucacgacgugcucaccguccaguuccugauccuugggaugcugcucaugacaggaggcguuacgcggcgcgggagcgccuacuauauguaccuggauagaaacgacgcuggagaggccauuuccuuucccaccacacuuggcaugaauaaaugcuauauccaaauuauggaucuggggcauaugugugacgcgaccaugucuuacgaaugcccuaugcucgaugagggaguggaaccggacgauguggacuguuggugcaacacaaccagcacaugggucguguauggcaccugucaccauaagaaaggcgaggcucggcgcuccagacgggccguuacgcugcccucucacagcacccgcaagcugcagacaagaucccagaccuggcucgaaagccgggaguacacaaaacaucugauccgcguggagaauuggauuuucagaaacccuggguuugcccuugcugccgcugccaucgcguggcugcucggaucuuccaccagccagaaggucaucuaucuggugaugauucuucugaucgcccccgcuuacucuauucggugcaucggcguuuccaaucgcgauuucguggaagggaugagcggaggcacgugggucgacauugugcucgagcacgggggaugugugacagucauggcccaagauaagccuaccguugacaucgaacuggugacaaccaccgugucuaacauggcugaggucagauccuacugcuaugaggccagcauuuccgauauggcgucugacagccggugucccacacagggcgaagccuaccuggacaaacaguccgauacgcaguaugugugcaagagaacccucguugaccgcggcugggggaauggauguggccuguuugggaaaggaagccuugugacaugcgcuaaguucgccugcucuaaaaagaugaccggcaaguccauccaaccugagaaccuggaauaccggaucaugcucagcguccacgggucucagcauagcggaaugauugugaaugauacaggccacgagaccgacgaaaacagagcuaaaguugagaucacgcccaauuccccgcgcgccgaggccacacugggcggguuuggaucucuuggccuggauugugaaccucggaccgggcucgacuucagcgaucuguauuaccugaccaugaacaauaagcauuggcucgugcacaaagagugguuucacgacauuccccugccuuggcaugcuggagcggauacaggcacaccccacuggaacaauaaggaagcccuugucgaguucaaagacgcucaugccaagagacagacaguggucgugcuggggucccaggaaggcgccguucacacggcucucgccggagcgcuggaggcugagauggauggcgccaaagggcgccuuagcucuggacaucugaagugccggcucaagauggacaaacugagacugaagggcguguccuauagccucuguaccgccgcuuuuacauucaccaaaaucccggccgaaacacugcacgggaccgucacgguggagguucaauacgcuggaaccgacggcccuugcaaggugcccgcccagauggcggucgauaugcagacacuuaccccuguggggcgccugauuacagccaaccccgugaucaccgaaucuacggagaacuccaaaaugaugcucgaacuggaucccccuuuuggcgacagcuacaucguuauuggagucggcgagaagaagaucacacaccauuggcaccgguccgggucuaccauuggaaaggcuuucgaggccacagugagaggcgcuaaacgcauggccgugcugggggacaccgcgugggauuucggaagcgucggcggggcccuuaauucccucggcaaaggaauccaucaaauuuuuggcgcugccuucaagucucuguuugggggaaugagcugguucucccagauccugaucggcacccuccugauguggcuugggcugaacaccaaaaauggaagcauuucucucaugugucuggcucugggcggggugcuuaucuuucucuccacggccguuagcgccgacgugggcugcucugucgauuucuccaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8855 - RNA, 2356 nt, Artificial Sequence
  ZIKV prME variant mRNA Design 3 opt
gggagaaagcuuaccaugagaggccugagcucccggaagcgcagaucucacgacgugcucaccguccaguuccugauccuugggaugcugcucaugacaggagccguuacgcggcgcggcagcgcuuacuauauguaccuggauagaaacgacgccggggaggcgauuuccuuucccaccacacuuggaaugaauaaaugcuauauccaaauuauggaucugggccauaugugugacgcuaccaugucuuacgaaugcccuaugcucgaugaggggguggaaccggacgauguggacuguuggugcaacacaaccagcacaugggucguguauggaaccugucaccauaagaaaggcgaggcccggcgcuccagacgggccguuacgcugcccucucacagcacccgcaagcugcagacaagaucccagaccuggcucgaaagccgggaguacacaaaacaucugauccgcguggagaauuggauuuucagaaacccuggcuuugcucuugccgcugccgcgaucgccuggcugcucgggucuuccaccagccagaaggucaucuaucuggugaugauucuucugaucgcucccgccuacucuauucggugcaucggaguuuccaaucgcgauuucguggaaggcaugagcgggggaacgugggucgacauugugcucgagcacggcgggugugugacagucauggcucaagauaagccuaccguugacaucgaacuggugacaaccaccgugucuaacauggccgaggucagauccuacugcuaugaggcgagcauuuccgauauggccucugacagccggugucccacacagggagaggcuuaccuggacaaacaguccgauacgcaguaugugugcaagagaacccucguugaccgcggcuggggcaauggguguggacuguuuggcaaagggagccuugugacaugcgccaaguucgcuugcucuaaaaagaugaccggaaaguccauccaaccugaaaaccuggaauaccggaucaugcucagcguccacggcucucagcauagcgggaugauugugaaugauacaggacacgagaccgacgaaaacagagccaaaguugagaucacgcccaauuccccgcgcgccgaggcuacacugggcggcuuugggucucuuggacuggauugugaaccucggaccggccucgacuucagcgaucuguauuaccugaccaugaacaauaagcauuggcucgugcacaaagagugguuucacgacauuccccugccuuggcaugcgggggccgauacaggaacaccccacuggaacaauaaggaagcucuugucgaguucaaagacgcccaugccaagagacagacaguggucgugcugggcucccaggaaggggcuguucacacggcccucgcgggcgcucuggaggccgagauggauggagccaaaggccgccuuagcucugggcaucugaagugccggcucaagauggacaaacugagacugaagggaguguccuauagccucuguaccgcugccuuuacauucaccaaaaucccggcugaaacacugcacggcaccgucacgguggagguucaauacgccgggaccgacggaccuugcaaggugcccgcgcagauggccgucgauaugcagacacuuaccccugugggccgccugauuacagcuaaccccgugaucaccgaaucuacggagaacuccaaaaugaugcucgaacuggaucccccuuuuggggacagcuacaucguuauuggcgucggagagaagaagaucacacaccauuggcaccgguccggcucuaccauugggaaagccuucgaggcuacagugagaggagccaagcgcauggcggugcugggcgacaccgccugggauuucgggagcgucggaggcgcucuuaauucccucgggaaaggcauccaucaaauuuuuggagccgcuuucaagucucuguuuggcgggaugagcugguucucccagauccugaucggaacccuccugauguggcuuggccugaacaccaaaaaugggagcauuucucucaugugucuggcccugggaggcgugcuuaucuuucucuccacggccguuagcgcugacguggggugcucugucgauuucuccaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8856 - RNA, 2347 nt, Artificial Sequence
  ZIKV prME variant mRNA Design 3 opt
gggagaaagcuuaccaugagaaucauuaacgcccggaaggagaaaaagcgcagaggcgcugacaccagcguggggaucgucggacugcuccugacaacggccauggcggcugaaguuacccggcgcggcuccgccuacuauauguaccuugauagaaaugacgccggggaggcuauuucuuuccccacaacccugggaaugaacaaaugcuauauccagauuauggaucucggccacaugugugacgccacaaugagcuacgaaugcccuaugcuggaugaggggguggaaccggacgauguggacuguuggugcaauaccacauccaccugggucguguauggaacgugucaucacaagaaaggcgaggcucggcgcucuagacgggccguuacccuucccagccauuccacacgcaagcugcaaaccagaucucagacauggcucgagagccgggaauacaccaagcaccugauccgcguggagaacuggaucuuuagaaauccuggcuucgcgcuggccgcugccgcuauugccuggcuccugggguccagcacgucucagaaagucaucuaucuugugaugauucugcucaucgcgcccgccuacuccauucggugcaucggaguuagcaaccgcgauuuuguggaaggcaugucugggggaacaugggucgacauugugcuggagcauggcgggugugugaccgucauggcucaggauaagccuacaguugacaucgagcuugugaccaccacaguguccaauauggccgaagucagaagcuacugcuaugaggcuucuaucuccgauauggccagcgacucccggugucccacgcaaggagaagccuaccuggacaaacagucugauacccaguaugugugcaagagaacacucguugaccgcggcuggggcaacggguguggacuguucggcaaagggagccuggugaccugcgcuaaguuugcgugcuccaagaaaaugacaggaaagagcauucagccugagaaucucgaauaccggaucaugcugucuguccacggcucccaacacagcgggaugauugugaacgauaccggacaugagacggacgagaauagagccaaaguugaaaucacaccgaacucuccccgcgcugaggccacccuuggcggcuucgggagccugggacucgauugugaaccucggaccggccuggacuuuuccgaucuuuauuaccugacaaugaauaacaagcacuggcucgugcauaaagagugguuccacgacauuccccugccuuggcacgccggggcugauaccggaacaccccauuggaauaacaaggaagcccuggucgaguuuaaagacgcgcacgcuaagagacagacgguggucgugcucggcucucaggagggggccguucauaccgcccuggcuggcgcccuugaagcugagauggauggagccaagggccgccugagcuccgggcaccucaaaugccggcugaagauggacaaacuuagacugaagggagugagcuauucucucuguacagcggccuucaccuuuacaaaaaucccggcugaaacccugcauggcacggucaccguggagguucaguacgccgggacagacggaccuugcaaggugcccgcucaaauggccgucgauaugcagacccugacaccugugggccgccucaucaccgcgaaccccgugauuacggaauccacagagaauagcaagaugaugcuggagcuugaucccccuuucggggacucuuacaucguuauuggcgucggagagaaaaagaucacccaccacuggcaucgguccggcagcacaauugggaaagccuuugaagcuaccgugagaggagccaagcgcauggcugugcugggcgacaccgccugggauuucggguccgucggaggcgcccucaacucucuggggaaaggcauccaccagaucuucggagcugcguuuaagagccuguucggcgggauguccugguuuucucaaauucuuaucggaacacuccugauguggcugggccucaauacgaagaacgggagcauuucccugaugugucuugcccugggaggcgugcucaucuuccugagcaccgcuguuucugccgacguggggugcugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8857 - RNA, 2344 nt, Artificial Sequence
  ZIKV prME variant mRNA Design 3 opt
gggagaaagcuuaccaugaucauuaacgccagaaaggagaaaaagcggcgcggcgcugacaccagcguggggaucgucggacugcuccugacaacggccauggcggcugaaguuaccagacggggcuccgccuacuauauguaccuugaucgcaaugacgccggggaggcuauuucuuuccccacaacccugggaaugaacaaaugcuauauccagauuauggaucucggccacaugugugacgccacaaugagcuacgaaugcccuaugcuggaugaggggguggaaccggacgauguggacuguuggugcaauaccacauccaccugggucguguauggaacgugucaucacaagaaaggcgaggcuagacggucucgcagagccguuacccuucccagccauuccacacggaagcugcaaacccgcucucagacauggcucgagagcagagaauacaccaagcaccugauccggguggagaacuggaucuuucgcaauccuggcuucgcgcuggccgcugccgcuauugccuggcuccugggguccagcacgucucagaaagucaucuaucuugugaugauucugcucaucgcgcccgccuacuccauuagaugcaucggaguuagcaaccgggauuuuguggaaggcaugucugggggaacaugggucgacauugugcuggagcauggcgggugugugaccgucauggcucaggauaagccuacaguugacaucgagcuugugaccaccacaguguccaauauggccgaaguccgcagcuacugcuaugaggcuucuaucuccgauauggccagcgacuccagaugucccacgcaaggagaagccuaccuggacaaacagucugauacccaguaugugugcaagcggacacucguugacagaggcuggggcaacggguguggacuguucggcaaagggagccuggugaccugcgcuaaguuugcgugcuccaagaaaaugacaggaaagagcauucagccugagaaucucgaauaccgcaucaugcugucuguccacggcucccaacacagcgggaugauugugaacgauaccggacaugagacggacgagaaucgggccaaaguugaaaucacaccgaacucucccagagcugaggccacccuuggcggcuucgggagccugggacucgauugugaaccucgcaccggccuggacuuuuccgaucuuuauuaccugacaaugaauaacaagcacuggcucgugcauaaagagugguuccacgacauuccccugccuuggcacgccggggcugauaccggaacaccccauuggaauaacaaggaagcccuggucgaguuuaaagacgcgcacgcuaagcggcagacgguggucgugcucggcucucaggagggggccguucauaccgcccuggcuggcgcccuugaagcugagauggauggagccaagggcagacugagcuccgggcaccucaaaugccgccugaagauggacaaacuucggcugaagggagugagcuauucucucuguacagcggccuucaccuuuacaaaaaucccggcugaaacccugcauggcacggucaccguggagguucaguacgccgggacagacggaccuugcaaggugcccgcucaaauggccgucgauaugcagacccugacaccugugggcagacucaucaccgcgaaccccgugauuacggaauccacagagaauagcaagaugaugcuggagcuugaucccccuuucggggacucuuacaucguuauuggcgucggagagaaaaagaucacccaccacuggcaucgcuccggcagcacaauugggaaagccuuugaagcuaccgugcggggagccaagagaauggcugugcugggcgacaccgccugggauuucggguccgucggaggcgcccucaacucucuggggaaaggcauccaccagaucuucggagcugcguuuaagagccuguucggcgggauguccugguuuucucaaauucuuaucggaacacuccugauguggcugggccucaauacgaagaacgggagcauuucccugaugugucuugcccugggaggcgugcucaucuuccugagcaccgcuguuucugccgacguggggugcugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8858 - RNA, 2341 nt, Artificial Sequence
  ZIKV prME variant mRNA Design 3 opt
gggagaaagcuuaccaugaucaacgccagaaaggagaaaaagcggcgcggcgcugacaccagcguggggauugucggacugcuccugacaacggccauggcggcugaaguuaccagacggggcuccgccuacuauauguaccuugaucgcaaugacgccggggaggcuaucucuuuccccacaacccugggaaugaacaaaugcuauauucagaucauggaucucggccacaugugugacgccacaaugagcuacgaaugcccuaugcuggaugaggggguggaaccggacgauguggacuguuggugcaauaccacauccaccugggucguguauggaacgugucaucacaagaaaggcgaggcuagacggucucgcagagccguuacccuucccagccauuccacacggaagcugcaaacccgcucucagacauggcucgagagcagagaauacaccaagcaccugauucggguggagaacuggaucuuucgcaauccuggcuucgcgcuggccgcugccgcuaucgccuggcuccugggguccagcacgucucagaaagucauuuaucuugugaugauccugcucauugcgcccgccuacuccaucagaugcauuggaguuagcaaccgggauuuuguggaaggcaugucugggggaacaugggucgacaucgugcuggagcauggcgggugugugaccgucauggcucaggauaagccuacaguugacauugagcuugugaccaccacaguguccaauauggccgaaguccgcagcuacugcuaugaggcuucuaucuccgauauggccagcgacuccagaugucccacgcaaggagaagccuaccuggacaaacagucugauacccaguaugugugcaagcggacacucguugacagaggcuggggcaacggguguggacuguucggcaaagggagccuggugaccugcgcuaaguuugcgugcuccaagaaaaugacaggaaagagcauccagccugagaaucucgaauaccgcauuaugcugucuguccacggcucccaacacagcgggaugaucgugaacgauaccggacaugagacggacgagaaucgggccaaaguugaaauuacaccgaacucucccagagcugaggccacccuuggcggcuucgggagccugggacucgauugugaaccucgcaccggccuggacuuuuccgaucuuuauuaccugacaaugaauaacaagcacuggcucgugcauaaagagugguuccacgacaucccccugccuuggcacgccggggcugauaccggaacaccccauuggaauaacaaggaagcccuggucgaguuuaaagacgcgcacgcuaagcggcagacgguggucgugcucggcucucaggagggggccguucauaccgcccuggcuggcgcccuugaagcugagauggauggagccaagggcagacugagcuccgggcaccucaaaugccgccugaagauggacaaacuucggcugaagggagugagcuauucucucuguacagcggccuucaccuuuacaaaaauuccggcugaaacccugcauggcacggucaccguggagguucaguacgccgggacagacggaccuugcaaggugcccgcucaaauggccgucgauaugcagacccugacaccugugggcagacucaucaccgcgaaccccgugaucacggaauccacagagaauagcaagaugaugcuggagcuugaucccccuuucggggacucuuacauuguuaucggcgucggagagaaaaagauuacccaccacuggcaucgcuccggcagcacaaucgggaaagccuuugaagcuaccgugcggggagccaagagaauggcugugcugggcgacaccgccugggauuucggguccgucggaggcgcccucaacucucuggggaaaggcauucaccagaucuucggagcugcguuuaagagccuguucggcgggauguccugguuuucucaaauccuuauuggaacacuccugauguggcugggccucaauacgaagaacgggagcaucucccugaugugucuugcccugggaggcgugcucauuuuccugagcaccgcuguuucugccgacguggggugcugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8859 - RNA, 2338 nt, Artificial Sequence
  ZIKV prME variant mRNA Design 3 opt
gggagaaagcuuaccaugaacgccagaaaggagaaaaagcggcgcggcgcugacaccagcguggggaucgucggacugcuccugacaacggccauggcggcugaaguuaccagacggggcuccgccuacuauauguaccuugaucgcaaugacgccggggaggcuauuucuuuccccacaacccugggaaugaacaaaugcuauauccagauuauggaucucggccacaugugugacgccacaaugagcuacgaaugcccuaugcuggaugaggggguggaaccggacgauguggacuguuggugcaauaccacauccaccugggucguguauggaacgugucaucacaagaaaggcgaggcuagacggucucgcagagccguuacccuucccagccauuccacacggaagcugcaaacccgcucucagacauggcucgagagcagagaauacaccaagcaccugauccggguggagaacuggauuuuucgcaauccuggcuucgcgcuggccgcugccgcuaucgccuggcuccugggguccagcacgucucagaaagucaucuaucuugugaugauucugcucaucgcgcccgccuacuccauuagaugcaucggaguuagcaaccgggauuuuguggaaggcaugucugggggaacaugggucgacauugugcuggagcauggcgggugugugaccgucauggcucaggauaagccuacaguugacaucgagcuugugaccaccacaguguccaauauggccgaaguccgcagcuacugcuaugaggcuucuauuuccgauauggccagcgacuccagaugucccacgcaaggagaagccuaccuggacaaacagucugauacccaguaugugugcaagcggacacucguugacagaggcuggggcaacggguguggacuguucggcaaagggagccuggugaccugcgcuaaguuugcgugcuccaagaaaaugacaggaaagagcauccagccugagaaucucgaauaccgcaucaugcugucuguccacggcucccaacacagcgggaugauugugaacgauaccggacaugagacggacgagaaucgggccaaaguugaaaucacaccgaacucucccagagcugaggccacccuuggcggcuucgggagccugggacucgauugugaaccucgcaccggccuggacuuuuccgaucuuuauuaccugacaaugaauaacaagcacuggcucgugcauaaagagugguuccacgacauuccccugccuuggcacgccggggcugauaccggaacaccccauuggaauaacaaggaagcccuggucgaguuuaaagacgcgcacgcuaagcggcagacgguggucgugcucggcucucaggagggggccguucauaccgcccuggcuggcgcccuugaagcugagauggauggagccaagggcagacugagcuccgggcaccucaaaugccgccugaagauggacaaacuucggcugaagggagugagcuauucucucuguacagcggccuucaccuuuacaaaaaucccggcugaaacccugcauggcacggucaccguggagguucaguacgccgggacagacggaccuugcaaggugcccgcucaaauggccgucgauaugcagacccugacaccugugggcagacucauuaccgcgaaccccgugaucacggaauccacagagaauagcaagaugaugcuggagcuugaucccccuuucggggacucuuacaucguuauuggcgucggagagaaaaagaucacccaccacuggcaucgcuccggcagcacaauugggaaagccuuugaagcuaccgugcggggagccaagagaauggcugugcugggcgacaccgccugggauuucggguccgucggaggcgcccucaacucucuggggaaaggcauccaccagauuuucggagcugcguuuaagagccuguucggcgggauguccugguuuucucaaauccuuaucggaacacuccugauguggcugggccucaauacgaagaacgggagcauuucccugaugugucuugcccugggaggcgugcucaucuuccugagcaccgcuguuucugccgacguggggugcugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8860 - RNA, 2335 nt, Artificial Sequence
  ZIKV prME variant mRNA Design 3 opt
gggagaaagcuuaccauggccagaaaggagaaaaagcggcgcggcgcugacaccagcguggggaucgucggacugcuccugacaacggccauggcggcugaaguuaccagacggggcuccgccuacuauauguaccuugaucgcaacgacgccggggaggcuauuucuuuccccacaacccugggaaugaauaaaugcuauauccagauuauggaucucggccacaugugugacgccacaaugagcuacgaaugcccuaugcuggaugaggggguggaaccggacgauguggacuguuggugcaacaccacauccaccugggucguguauggaacgugucaucacaagaaaggcgaggcuagacggucucgcagagccguuacccuucccagccauuccacacggaagcugcaaacccgcucucagacauggcucgagagcagagaauacaccaagcaccugauccggguggagaauuggauuuuucgcaacccuggcuucgcgcuggccgcugccgcuaucgccuggcuccugggguccagcacgucucagaaagucaucuaucuugugaugauucugcucaucgcgcccgccuacuccauuagaugcaucggaguuagcaaucgggauuuuguggaaggcaugucugggggaacaugggucgacauugugcuggagcauggcgggugugugaccgucauggcucaggauaagccuacaguugacaucgagcuugugaccaccacaguguccaacauggccgaaguccgcagcuacugcuaugaggcuucuauuuccgauauggccagcgacuccagaugucccacgcaaggagaagccuaccuggacaaacagucugauacccaguaugugugcaagcggacacucguugacagaggcuggggcaauggguguggacuguucggcaaagggagccuggugaccugcgcuaaguuugcgugcuccaagaaaaugacaggaaagagcauccagccugagaaccucgaauaccgcaucaugcugucuguccacggcucccaacacagcgggaugauugugaaugauaccggacaugagacggacgagaaccgggccaaaguugaaaucacacccaauucucccagagcugaggccacccuuggcggcuucgggagccugggacucgauugugaaccucgcaccggccuggacuuuuccgaucuuuauuaccugacaaugaacaauaagcacuggcucgugcauaaagagugguuccacgacauuccccugccuuggcacgccggggcugauaccggaacaccccauuggaacaauaaggaagcccuggucgaguuuaaagacgcgcacgcuaagcggcagacgguggucgugcucggcucucaggagggggccguucauaccgcccuggcuggcgcccuugaagcugagauggauggagccaagggcagacugagcuccgggcaccucaaaugccgccugaagauggacaaacuucggcugaagggagugagcuauucucucuguacagcggccuucaccuuuacaaaaaucccggcugaaacccugcauggcacggucaccguggagguucaguacgccgggacagacggaccuugcaaggugcccgcucaaauggccgucgauaugcagacccugacaccugugggcagacucauuaccgcgaaccccgugaucacggaauccacagagaacagcaagaugaugcuggagcuugacccgccuuucggggauucuuacaucguuauuggcgucggagagaaaaagaucacccaccacuggcaucgcuccggcagcacaauugggaaagccuuugaagcuaccgugcggggagccaagagaauggcugugcugggcgacaccgccugggauuucggguccgucggaggcgcccucaauucucuggggaaaggcauccaccagauuuucggagcugcguuuaagagccuguucggcgggauguccugguuuucucaaauccuuaucggaacacuccugauguggcugggccucaacacgaagaaugggagcauuucccugaugugucuugcccugggaggcgugcucaucuuccugagcaccgcuguuucugccgacguggggugcugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8861 - RNA, 2332 nt, Artificial Sequence
  ZIKV prME variant mRNA Design 3 opt
gggagaaagcuuaccaugagaaaggagaaaaagcggcgcggcgccgacaccagcguggggaucgucggacugcuccugacaacggcuauggccgcggaaguuaccagacggggcuccgcuuacuauauguaccuugaucgcaacgacgccggggaggccauuucuuuccccacaacccugggaaugaauaaaugcuauauccagauuauggaucucggccacaugugugacgcuacaaugagcuacgaaugcccuaugcuggaugaggggguggaaccggacgauguggacuguuggugcaacaccacauccaccugggucguguauggaacgugucaucacaagaaaggcgaggccagacggucucgcagagcuguuacccuucccagccauuccacacggaagcugcaaacccgcucucagacauggcucgagagcagagaauacaccaagcaccugauccggguggagaauuggauuuuucgcaacccuggcuucgcccuggcggccgcugccaucgcuuggcuccugggguccagcacgucucagaaagucaucuaucuugugaugauucugcucaucgcccccgcguacuccauuagaugcaucggaguuagcaaucgggauuuuguggaaggcaugucugggggaacaugggucgacauugugcuggagcauggcgggugugugaccgucauggcccaggauaagccuacaguugacaucgagcuugugaccaccacaguguccaacauggcugaaguccgcagcuacugcuaugaggccucuauuuccgauauggcuagcgacuccagaugucccacgcaaggagaagccuaccuggacaaacagucugauacccaguaugugugcaagcggacacucguugacagaggcuggggcaauggguguggacuguucggcaaagggagccuggugaccugcgccaaguuugcuugcuccaagaaaaugacaggaaagagcauccagccugagaaccucgaauaccgcaucaugcugucuguccacggcucccaacacagcgggaugauugugaaugauaccggacaugagacggacgagaaccgggcgaaaguugaaaucacacccaauucucccagagccgaggcuacccuuggcggcuucgggagccugggacucgauugugaaccucgcaccggccuggacuuuuccgaucuuuauuaccugacaaugaacaauaagcacuggcucgugcauaaagagugguuccacgacauuccccugccuuggcacgccggggccgauaccggaacaccccauuggaacaauaaggaagcucuggucgaguuuaaagacgcccacgcgaagcggcagacgguggucgugcucggcucucaggagggggcuguucauaccgcccuggccggcgcucuugaagccgagauggauggagcuaagggcagacugagcuccgggcaccucaaaugccgccugaagauggacaaacuucggcugaagggagugagcuauucucucuguacagccgcguucaccuuuacaaaaaucccggccgaaacccugcauggcacggucaccguggagguucaguacgcugggacagacggaccuugcaaggugcccgcccaaauggcugucgauaugcagacccugacaccugugggcagacucauuaccgccaaccccgugaucacggaauccacagagaacagcaagaugaugcuggagcuugacccgccuuucggggauucuuacaucguuauuggcgucggagagaaaaagaucacccaccacuggcaucgcuccggcagcacaauugggaaagcguuugaagccaccgugcggggagcuaagagaauggccgugcugggcgacaccgcuugggauuucggguccgucggaggcgcccucaauucucuggggaaaggcauccaccagauuuucggagccgcuuuuaagagccuguucggcgggauguccugguuuucucaaauccuuaucggaacacuccugauguggcugggccucaacacgaagaaugggagcauuucccugaugugucuugcgcugggaggcgugcucaucuuccugagcaccgccguuucugcugacguggggugcugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8862 - RNA, 2329 nt, Artificial Sequence
  ZIKV prME variant mRNA Design 3 opt
gggagaaagcuuaccaugaaggagaaaaagagacggggcgccgacaccagcguggggaucgucggacugcuccugacaacggcuauggccgcggaaguuacccgcagaggcuccgcuuacuauauguaccuugaucggaacgacgccggggaggccauuucuuuccccacaacccugggaaugaauaaaugcuauauccagauuauggaucucggccacaugugugacgcuacaaugagcuacgaaugcccuaugcuggaugaggggguggaaccggacgauguggacuguuggugcaacaccacauccaccugggucguguauggaacgugucaucacaagaaaggcgaggcccgcagaucucggcgcgcuguuacccuucccagccauuccacaagaaagcugcaaacccggucucagacauggcucgagagccgcgaauacaccaagcaccugaucagaguggagaauuggauuuuucggaacccuggcuucgcccuggcggccgcugccaucgcuuggcuccugggguccagcacgucucagaaagucaucuaucuugugaugauucugcucaucgcccccgcguacuccauucgcugcaucggaguuagcaauagagauuuuguggaaggcaugucugggggaacaugggucgacauugugcuggagcauggcgggugugugaccgucauggcccaggauaagccuacaguugacaucgagcuugugaccaccacaguguccaacauggcugaaguccggagcuacugcuaugaggccucuauuuccgauauggcuagcgacucccgcugucccacgcaaggagaagccuaccuggacaaacagucugauacccaguaugugugcaagagaacacucguugaccggggcuggggcaauggguguggacuguucggcaaagggagccuggugaccugcgccaaguuugcuugcuccaagaaaaugacaggaaagagcauccagccugagaaccucgaauacagaaucaugcugucuguccacggcucccaacacagcgggaugauugugaaugauaccggacaugagacggacgagaaccgcgcgaaaguugaaaucacacccaauucuccccgggccgaggcuacccuuggcggcuucgggagccugggacucgauugugaaccuagaaccggccuggacuuuuccgaucuuuauuaccugacaaugaacaauaagcacuggcucgugcauaaagagugguuccacgacauuccccugccuuggcacgccggggccgauaccggaacaccccauuggaacaauaaggaagcucuggucgaguuuaaagacgcccacgcgaagcgccagacgguggucgugcucggcucucaggagggggcuguucauaccgcccuggccggcgcucuugaagccgagauggauggagcuaagggccggcugagcuccgggcaccucaaaugcagacugaagauggacaaacuucgccugaagggagugagcuauucucucuguacagccgcguucaccuuuacaaaaaucccggccgaaacccugcauggcacggucaccguggagguucaguacgcugggacagacggaccuugcaaggugcccgcccaaauggcugucgauaugcagacccugacaccugugggccggcucauuaccgccaaccccgugaucacggaauccacagagaacagcaagaugaugcuggagcuugacccgccuuucggggauucuuacaucguuauuggcgucggagagaaaaagaucacccaccacuggcauagauccggcagcacaauugggaaagcguuugaagccaccgugcgcggagcuaagcggauggccgugcugggcgacaccgcuugggauuucggguccgucggaggcgcccucaauucucuggggaaaggcauccaccagauuuucggagccgcuuuuaagagccuguucggcgggauguccugguuuucucaaauccuuaucggaacacuccugauguggcugggccucaacacgaagaaugggagcauuucccugaugugucuugcgcugggaggcgugcucaucuuccugagcaccgccguuucugcugacguggggugcugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8863 - RNA, 2326 nt, Artificial Sequence
  ZIKV prME variant mRNA Design 3 opt
gggagaaagcuuaccauggagaagaaaagacggggcgccgacaccagcguggggaucgucggacugcuccugacaacggcuauggccgcggaaguuacccgcagaggcuccgcuuacuauauguaccuugaucggaacgacgccggggaggccauuucuuuccccacaacccugggaaugaauaagugcuauauccagauuauggaucucggccacaugugugacgcuacaaugagcuacgaaugcccuaugcuggaugaggggguggaaccggacgauguggacuguuggugcaacaccacauccaccugggucguguauggaacgugucaucacaaaaagggcgaggcccgcagaucucggcgcgcuguuacccuucccagccauuccacaagaaaacugcaaacccggucucagacauggcucgagagccgcgaauacaccaagcaccugaucagaguggagaauuggauuuuucggaacccuggcuucgcccuggcggccgcugccaucgcuuggcuccugggguccagcacgucucagaaggucaucuaucuugugaugauucugcucaucgcccccgcguacuccauucgcugcaucggaguuagcaauagagauuuuguggaaggcaugucugggggaacaugggucgacauugugcuggagcauggcgggugugugaccgucauggcccaggauaaaccuacaguugacaucgagcuugugaccaccacaguguccaacauggcugaaguccggagcuacugcuaugaggccucuauuuccgauauggcuagcgacucccgcugucccacgcaaggagaagccuaccuggacaagcagucugauacccaguaugugugcaaaagaacacucguugaccggggcuggggcaauggguguggacuguucggcaaggggagccuggugaccugcgccaaauuugcuugcuccaagaagaugacaggaaaaagcauccagccugagaaccucgaauacagaaucaugcugucuguccacggcucccaacacagcgggaugauugugaaugauaccggacaugagacggacgagaaccgcgcgaagguugaaaucacacccaauucuccccgggccgaggcuacccuuggcggcuucgggagccugggacucgauugugaaccuagaaccggccuggacuuuuccgaucuuuauuaccugacaaugaacaauaaacacuggcucgugcauaaggagugguuccacgacauuccccugccuuggcacgccggggccgauaccggaacaccccauuggaacaauaaagaagcucuggucgaguuuaaggacgcccacgcgaaacgccagacgguggucgugcucggcucucaggagggggcuguucauaccgcccuggccggcgcucuugaagccgagauggauggagcuaagggccggcugagcuccgggcaccucaagugcagacugaaaauggacaaacuucgccugaagggagugagcuauucucucuguacagccgcguucaccuuuacaaagaucccggccgaaacccugcauggcacggucaccguggagguucaguacgcugggacagacggaccuugcaaagugcccgcccaaauggcugucgauaugcagacccugacaccugugggccggcucauuaccgccaaccccgugaucacggaauccacagagaacagcaagaugaugcuggagcuugacccgccuuucggggauucuuacaucguuauuggcgucggagaaaagaaaaucacccaccacuggcauagauccggcagcacaauugggaaggcguuugaggccaccgugcgcggagcuaaacggauggccgugcugggcgacaccgcuugggauuucggguccgucggaggcgcccucaauucucuggggaagggcauccaccagauuuucggagccgcuuuuaaaagccuguucggcgggauguccugguuuucucaaauccuuaucggaacacuccugauguggcugggccucaacacgaagaaugggagcauuucccugaugugucuugcgcugggaggcgugcucaucuuccugagcaccgccguuucugcugacguggggugcugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8864 - RNA, 2323 nt, Artificial Sequence
  ZIKV prME variant mRNA Design 3 opt
gggagaaagcuuaccaugaagaaaagacggggcgccgacaccagcguggggaucgucggacugcuccugacaacggcuauggccgcggagguuacccgcagaggcuccgcuuacuauauguaccuugaucggaacgacgccggggaagccauuucuuuccccacaacccugggaaugaauaagugcuauauccagauuauggaucucggccacaugugugacgcuacaaugagcuacgagugcccuaugcuggaugaagggguggagccggacgauguggacuguuggugcaacaccacauccaccugggucguguauggaacgugucaucacaaaaagggcgaagcccgcagaucucggcgcgcuguuacccuucccagccauuccacaagaaaacugcaaacccggucucagacauggcucgagagccgcgaguacaccaagcaccugaucagaguggaaaauuggauuuuucggaacccuggcuucgcccuggcggccgcugccaucgcuuggcuccugggguccagcacgucucagaaggucaucuaucuugugaugauucugcucaucgcccccgcguacuccauucgcugcaucggaguuagcaauagagauuuuguggagggcaugucugggggaacaugggucgacauugugcuggaacauggcgggugugugaccgucauggcccaggauaaaccuacaguugacaucgagcuugugaccaccacaguguccaacauggcugagguccggagcuacugcuaugaagccucuauuuccgauauggcuagcgacucccgcugucccacgcaaggagaggccuaccuggacaagcagucugauacccaguaugugugcaaaagaacacucguugaccggggcuggggcaauggguguggacuguucggcaaggggagccuggugaccugcgccaaauuugcuugcuccaagaagaugacaggaaaaagcauccagccugaaaaccucgaguacagaaucaugcugucuguccacggcucccaacacagcgggaugauugugaaugauaccggacaugaaacggacgagaaccgcgcgaagguugagaucacacccaauucuccccgggccgaagcuacccuuggcggcuucgggagccugggacucgauugugagccuagaaccggccuggacuuuuccgaucuuuauuaccugacaaugaacaauaaacacuggcucgugcauaaggaaugguuccacgacauuccccugccuuggcacgccggggccgauaccggaacaccccauuggaacaauaaagaggcucuggucgaauuuaaggacgcccacgcgaaacgccagacgguggucgugcucggcucucaggagggggcuguucauaccgcccuggccggcgcucuugaggccgaaauggauggagcuaagggccggcugagcuccgggcaccucaagugcagacugaaaauggacaaacuucgccugaagggagugagcuauucucucuguacagccgcguucaccuuuacaaagaucccggccgagacccugcauggcacggucaccguggaaguucaguacgcugggacagacggaccuugcaaagugcccgcccaaauggcugucgauaugcagacccugacaccugugggccggcucauuaccgccaaccccgugaucacggaguccacagaaaacagcaagaugaugcuggagcuugacccgccuuucggggauucuuacaucguuauuggcgucggagagaagaaaaucacccaccacuggcauagauccggcagcacaauugggaaggcguuugaagccaccgugcgcggagcuaaacggauggccgugcugggcgacaccgcuugggauuucggguccgucggaggcgcccucaauucucuggggaagggcauccaccagauuuucggagccgcuuuuaaaagccuguucggcgggauguccugguuuucucaaauccuuaucggaacacuccugauguggcugggccucaacacgaagaaugggagcauuucccugaugugucuugcgcugggaggcgugcucaucuuccugagcaccgccguuucugcugacguggggugcugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8865 - RNA, 2320 nt, Artificial Sequence
  ZIKV prME variant mRNA Design 3 opt
gggagaaagcuuaccaugaagagacggggcgccgacaccagcguggggaucgucggacugcuccugacaacggcuauggccgcggagguuacccgcagaggcuccgcuuacuauauguaccuugaucggaacgacgccggggaagccauuucuuuccccacaacccugggaaugaauaaaugcuauauccagauuauggaucucggccacaugugugacgcuacaaugagcuacgagugcccuaugcuggaugaagggguggagccggacgauguggacuguuggugcaacaccacauccaccugggucguguauggaacgugucaucacaagaaaggcgaagcccgcagaucucggcgcgcuguuacccuucccagccauuccacaagaaagcugcaaacccggucucagacauggcucgagagccgcgaguacaccaaacaccugaucagaguggaaaauuggauuuuucggaacccuggcuucgcccuggcggccgcugccaucgcuuggcuccugggguccagcacgucucagaaggucaucuaucuugugaugauucugcucaucgcccccgcguacuccauucgcugcaucggaguuagcaauagagauuuuguggagggcaugucugggggaacaugggucgacauugugcuggaacauggcgggugugugaccgucauggcccaggauaagccuacaguugacaucgagcuugugaccaccacaguguccaacauggcugagguccggagcuacugcuaugaagccucuauuuccgauauggcuagcgacucccgcugucccacgcaaggagaggccuaccuggacaaacagucugauacccaguaugugugcaagagaacacucguugaccggggcuggggcaauggguguggacuguucggcaaagggagccuggugaccugcgccaaguuugcuugcuccaaaaagaugacaggaaagagcauccagccugaaaaccucgaguacagaaucaugcugucuguccacggcucccaacacagcgggaugauugugaaugauaccggacaugaaacggacgagaaccgcgcgaaaguugagaucacacccaauucuccccgggccgaagcuacccuuggcggcuucgggagccugggacucgauugugagccuagaaccggccuggacuuuuccgaucuuuauuaccugacaaugaacaauaagcacuggcucgugcauaaagaaugguuccacgacauuccccugccuuggcacgccggggccgauaccggaacaccccauuggaacaauaaggaggcucuggucgaauuuaaagacgcccacgcgaagcgccagacgguggucgugcucggcucucaggagggggcuguucauaccgcccuggccggcgcucuugaggccgaaauggauggagcuaaaggccggcugagcuccgggcaccucaagugcagacugaagauggacaaacuucgccugaagggagugagcuauucucucuguacagccgcguucaccuuuacaaaaaucccggccgagacccugcauggcacggucaccguggaaguucaguacgcugggacagacggaccuugcaaggugcccgcccaaauggcugucgauaugcagacccugacaccugugggccggcucauuaccgccaaccccgugaucacggaguccacagaaaacagcaaaaugaugcuggagcuugacccgccuuucggggauucuuacaucguuauuggcgucggagagaagaagaucacccaccacuggcauagauccggcagcacaauugggaaagcguuugaagccaccgugcgcggagcuaagcggauggccgugcugggcgacaccgcuugggauuucggguccgucggaggcgcccucaauucucuggggaaaggcauccaccagauuuucggagccgcuuuuaagagccuguucggcgggauguccugguuuucucaaauccuuaucggaacacuccugauguggcugggccucaacacgaaaaaugggagcauuucccugaugugucuugcgcugggaggcgugcucaucuuccugagcaccgccguuucugcugacguggggugcugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8866 - RNA, 2317 nt, Artificial Sequence
  ZIKV prME variant mRNA Design 3 opt
gggagaaagcuuaccaugagacggggcgccgacaccagcguggggaucgucggacugcuccugacaacggcuauggccgcggagguuacccgcagaggcuccgcuuacuauauguaccuugaucggaacgacgccggggaagccauuucuuuccccacaacccugggaaugaauaagugcuauauccagauuauggaucucggccacaugugugacgcuacaaugagcuacgagugcccuaugcuggaugaagggguggagccggacgauguggacuguuggugcaacaccacauccaccugggucguguauggaacgugucaucacaaaaagggcgaagcccgcagaucucggcgcgcuguuacccuucccagccauuccacaagaaaacugcaaacccggucucagacauggcucgagagccgcgaguacaccaagcaccugaucagaguggaaaauuggauuuuucggaacccuggcuucgcccuggcggccgcugccaucgcuuggcuccugggguccagcacgucucagaaagucaucuaucuugugaugauucugcucaucgcccccgcguacuccauucgcugcaucggaguuagcaauagagauuuuguggagggcaugucugggggaacaugggucgacauugugcuggaacauggcgggugugugaccgucauggcccaggauaagccuacaguugacaucgagcuugugaccaccacaguguccaacauggcugagguccggagcuacugcuaugaagccucuauuuccgauauggcuagcgacucccgcugucccacgcaaggagaggccuaccuggacaagcagucugauacccaguaugugugcaaaagaacacucguugaccggggcuggggcaauggguguggacuguucggcaaggggagccuggugaccugcgccaaauuugcuugcuccaagaaaaugacaggaaagagcauccagccugaaaaccucgaguacagaaucaugcugucuguccacggcucccaacacagcgggaugauugugaaugauaccggacaugaaacggacgagaaccgcgcgaagguugagaucacacccaauucuccccgggccgaagcuacccuuggcggcuucgggagccugggacucgauugugagccuagaaccggccuggacuuuuccgaucuuuauuaccugacaaugaacaauaaacacuggcucgugcauaaggaaugguuccacgacauuccccugccuuggcacgccggggccgauaccggaacaccccauuggaacaauaaagaggcucuggucgaauuuaaggacgcccacgcgaaacgccagacgguggucgugcucggcucucaggagggggcuguucauaccgcccuggccggcgcucuugaggccgaaauggauggagcuaagggccggcugagcuccgggcaccucaaaugcagacugaagauggacaaacuucgccugaagggagugagcuauucucucuguacagccgcguucaccuuuacaaagaucccggccgagacccugcauggcacggucaccguggaaguucaguacgcugggacagacggaccuugcaaagugcccgcccaaauggcugucgauaugcagacccugacaccugugggccggcucauuaccgccaaccccgugaucacggaguccacagaaaacagcaagaugaugcuggagcuugacccgccuuucggggauucuuacaucguuauuggcgucggagagaaaaagaucacccaccacuggcauagauccggcagcacaauugggaaggcguuugaagccaccgugcgcggagcuaaacggauggccgugcugggcgacaccgcuugggauuucggguccgucggaggcgcccucaauucucuggggaagggcauccaccagauuuucggagccgcuuuuaaaagccuguucggcgggauguccugguuuucucaaauccuuaucggaacacuccugauguggcugggccucaacacgaagaaugggagcauuucccugaugugucuugcgcugggaggcgugcucaucuuccugagcaccgccguuucugcugacguggggugcugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8867 - RNA, 2314 nt, Artificial Sequence
  ZIKV prME variant mRNA Design 3 opt
gggagaaagcuuaccaugagaggcgccgacaccagcguggggaucgucggacugcuccugacaacggcuauggccgcggagguuacccggcgcggcuccgcuuacuauauguaccuugauagaaacgacgccggggaagccauuucuuuccccacaacccugggaaugaauaagugcuauauccagauuauggaucucggccacaugugugacgcuacaaugagcuacgagugcccuaugcuggaugaagggguggagccggacgauguggacuguuggugcaacaccacauccaccugggucguguauggaacgugucaucacaaaaagggcgaagcccggcgcucuagacgggcuguuacccuucccagccauuccacacgcaaacugcaaaccagaucucagacauggcucgagagccgggaguacaccaagcaccugauccgcguggaaaauuggauuuuuagaaacccuggcuucgcccuggcggccgcugccaucgcuuggcuccugggguccagcacgucucagaaagucaucuaucuugugaugauucugcucaucgcccccgcguacuccauucggugcaucggaguuagcaaucgcgauuuuguggagggcaugucugggggaacaugggucgacauugugcuggaacauggcgggugugugaccgucauggcccaggauaagccuacaguugacaucgagcuugugaccaccacaguguccaacauggcugaggucagaagcuacugcuaugaagccucuauuuccgauauggcuagcgacucccggugucccacgcaaggagaggccuaccuggacaagcagucugauacccaguaugugugcaaacgcacacucguugacagaggcuggggcaauggguguggacuguucggcaaggggagccuggugaccugcgccaaauuugcuugcuccaagaaaaugacaggaaagagcauccagccugaaaaccucgaguaccggaucaugcugucuguccacggcucccaacacagcgggaugauugugaaugauaccggacaugaaacggacgagaacagagcgaagguugagaucacacccaauucuccccgcgccgaagcuacccuuggcggcuucgggagccugggacucgauugugagccucggaccggccuggacuuuuccgaucuuuauuaccugacaaugaacaauaaacacuggcucgugcauaaggaaugguuccacgacauuccccugccuuggcacgccggggccgauaccggaacaccccauuggaacaauaaagaggcucuggucgaauuuaaggacgcccacgcgaaaagacagacgguggucgugcucggcucucaggagggggcuguucauaccgcccuggccggcgcucuugaggccgaaauggauggagcuaagggccgccugagcuccgggcaccucaaaugccggcugaagauggacaaacuuagacugaagggagugagcuauucucucuguacagccgcguucaccuuuacaaagaucccggccgagacccugcauggcacggucaccguggaaguucaguacgcugggacagacggaccuugcaaagugcccgcccaaauggcugucgauaugcagacccugacaccugugggccgccucauuaccgccaaccccgugaucacggaguccacagaaaacagcaagaugaugcuggagcuugacccgccuuucggggauucuuacaucguuauuggcgucggagagaaaaagaucacccaccacuggcaucgguccggcagcacaauugggaaggcguuugaagccaccgugagaggagcuaaacgcauggccgugcugggcgacaccgcuugggauuucggguccgucggaggcgcccucaauucucuggggaagggcauccaccagauuuucggagccgcuuuuaaaagccuguucggcgggauguccugguuuucucaaauccuuaucggaacacuccugauguggcugggccucaacacgaagaaugggagcauuucccugaugugucuugcgcugggaggcgugcucaucuuccugagcaccgccguuucugcugacguggggugcugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8868 - RNA, 2311 nt, Artificial Sequence
  ZIKV prME variant mRNA Design 3 opt
gggagaaagcuuaccaugggcgccgacaccagcguggggaucgucggacugcuccugacaacggcuauggccgcggagguuaccagacggggcuccgcuuacuauauguaccuugaucgcaacgacgccggggaagccauuucuuuccccacaacccugggaaugaauaagugcuauauccagauuauggaucucggccacaugugugacgcuacaaugagcuacgagugcccuaugcuggaugaagggguggagccggacgauguggacuguuggugcaacaccacauccaccugggucguguauggaacgugucaucacaaaaagggcgaagccagacggucucgcagagcuguuacccuucccagccauuccacacggaaacugcaaacccgcucucagacauggcucgagagcagagaguacaccaagcaccugauccggguggaaaauuggauuuuucgcaacccuggcuucgcccuggcggccgcugccaucgcuuggcuccugggguccagcacgucucagaaagucaucuaucuugugaugauucugcucaucgcccccgcguacuccauuagaugcaucggaguuagcaaucgggauuuuguggagggcaugucugggggaacaugggucgacauugugcuggaacauggcgggugugugaccgucauggcccaggauaagccuacaguugacaucgagcuugugaccaccacaguguccaacauggcugagguccgcagcuacugcuaugaagccucuauuuccgauauggcuagcgacuccagaugucccacgcaaggagaggccuaccuggacaagcagucugauacccaguaugugugcaaacggacacucguugaccgcggcuggggcaauggguguggacuguucggcaaggggagccuggugaccugcgccaaauuugcuugcuccaagaaaaugacaggaaagagcauccagccugaaaaccucgaguacagaaucaugcugucuguccacggcucccaacacagcgggaugauugugaaugauaccggacaugaaacggacgagaaccgggcgaagguugagaucacacccaauucucccagagccgaagcuacccuuggcggcuucgggagccugggacucgauugugagccucgcaccggccuggacuuuuccgaucuuuauuaccugacaaugaacaauaaacacuggcucgugcauaaggaaugguuccacgacauuccccugccuuggcacgccggggccgauaccggaacaccccauuggaacaauaaagaggcucuggucgaauuuaaggacgcccacgcgaaacggcagacgguggucgugcucggcucucaggagggggcuguucauaccgcccuggccggcgcucuugaggccgaaauggauggagcuaagggcagacugagcuccgggcaccucaaaugccgccugaagauggacaaacuucggcugaagggagugagcuauucucucuguacagccgcguucaccuuuacaaagaucccggccgagacccugcauggcacggucaccguggaaguucaguacgcugggacagacggaccuugcaaagugcccgcccaaauggcugucgauaugcagacccugacaccugugggcagacucauuaccgccaaccccgugaucacggaguccacagaaaacagcaagaugaugcuggagcuugacccgccuuucggggauucuuacaucguuauuggcgucggagagaaaaagaucacccaccacuggcaucgcuccggcagcacaauugggaaggcguuugaagccaccgugcggggagcuaaaagaauggccgugcugggcgacaccgcuugggauuucggguccgucggaggcgcccucaauucucuggggaagggcauccaccagauuuucggagccgcuuuuaaaagccuguucggcgggauguccugguuuucucaaauccuuaucggaacacuccugauguggcugggccucaacacgaagaaugggagcauuucccugaugugucuugcgcugggaggcgugcucaucuuccugagcaccgccguuucugcugacguggggugcugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8869 - RNA, 2308 nt, Artificial Sequence
  ZIKV prME variant mRNA Design 3 opt
gggagaaagcuuaccauggccgacaccagcgugggcaucgucgggcugcuccugacaacggcuauggccgcggagguuaccagacggggauccgcuuacuauauguaccuugaucgcaacgacgccggcgaagccauuucuuuccccacaacccuggggaugaauaagugcuauauccagauuauggaucucggacacaugugugacgcuacaaugagcuacgagugcccuaugcuggaugaaggcguggagccggacgauguggacuguuggugcaacaccacauccaccugggucguguaugggacgugucaucacaaaaagggagaagccagacggucucgcagagcuguuacccuucccagccauuccacacggaaacugcaaacccgcucucagacauggcucgagagcagagaguacaccaagcaccugauccggguggaaaauuggauuuuucgcaacccuggcuucgcccuggcggccgcugccaucgcuuggcuccugggcuccagcacgucucagaaagucaucuaucuugugaugauucugcucaucgcccccgcguacuccauuagaugcaucgggguuagcaaucgggauuuuguggagggaaugucuggcgggacaugggucgacauugugcuggaacauggaggcugugugaccgucauggcccaggauaagccuacaguugacaucgagcuugugaccaccacaguguccaacauggcugagguccgcagcuacugcuaugaagccucuauuuccgauauggcuagcgacuccagaugucccacgcaaggggaggccuaccuggacaagcagucugauacccaguaugugugcaaacggacacucguugaccgcggauggggcaauggcugugggcuguucggaaagggcagccuggugaccugcgccaaauuugcuugcuccaagaaaaugacaggaaagagcauccagccugaaaaccucgaguacagaaucaugcugucuguccacgggucccaacacagcggcaugauugugaaugauaccgggcaugaaacggacgagaaccgggcgaagguugagaucacacccaauucucccagagccgaagcuacccuuggaggcuucggcagccuggggcucgauugugagccucgcaccggacuggacuuuuccgaucuuuauuaccugacaaugaacaauaaacacuggcucgugcauaaggaaugguuccacgacauuccccugccuuggcacgccggcgccgauaccgggacaccccauuggaacaauaaagaggcucuggucgaauuuaaggacgcccacgcgaaacggcagacgguggucgugcucggaucucaggagggcgcuguucauaccgcccuggccggggcucuugaggccgaaauggauggcgcuaagggaagacugagcuccggccaccucaaaugccgccugaagauggacaagcugcggcugaaaggggugagcuauucucucuguacagccgcguucaccuuuacaaagaucccggccgagacccugcauggaacggucaccguggaaguucaguacgcuggcacagacgggccuugcaaagugcccgcccaaauggcugucgauaugcagacccugacaccugugggaagacucauuaccgccaaccccgugaucacggaguccacagaaaacagcaagaugaugcuggagcuugacccgccuuucggcgauucuuacaucguuauuggggucggcgagaaaaagaucacccaccacuggcaucgcuccggaagcacaauuggcaaggcguuugaagccaccgugagaggggcuaaacggauggccgugcugggagacaccgcuugggauuucggcuccgucgggggagcccucaauucucugggcaaggggauccaccagauuuucggcgccgcuuuuaaaagccuguucggaggcauguccugguuuucucaaauccuuaucgggacacuccugauguggcugggacucaacacgaagaauggcagcauuucccugaugugucuugcgcuugggggagugcucaucuuccugagcaccgccguuucugcugacgugggcugcugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8870 - RNA, 2305 nt, Artificial Sequence
  ZIKV prME variant mRNA Design 3 opt
gggagaaagcuuaccauggacaccagcgugggcaucgucgggcugcuccugacaacggccauggcugccgagguuaccagacggggauccgcguacuauauguaccuugaucgcaacgacgcuggcgaagccauuucuuuccccacaacccuggggaugaauaagugcuauauccagauuauggaucucggacacaugugugacgccacaaugagcuacgagugcccuaugcuggaugaaggcguggagccggacgauguggacuguuggugcaacaccacauccaccugggucguguaugggacgugucaucacaaaaagggagaagcuagacggucucgcagagccguuacccuucccagccauuccacacggaaacugcaaacccgcucucagacauggcucgagagcagagaguacaccaagcaccugauccggguggaaaauuggauuuuucgcaacccuggcuucgcucuggccgcggccgcuaucgccuggcuccugggcuccagcacgucucagaaagucaucuaucuugugaugauucugcucaucgcucccgccuacuccauuagaugcaucgggguuagcaaucgggauuuuguggagggaaugucuggcgggacaugggucgacauugugcuggaacauggaggcugugugaccgucauggcgcaggauaagccuacaguugacaucgagcuugugaccaccacaguguccaacauggccgagguccgcagcuacugcuaugaagcuagcauuuccgauauggccagcgacuccagaugucccacgcaaggggaggcuuaccuggacaagcagucugauacccaguaugugugcaaacggacacucguugaccgcggauggggcaauggcugugggcuguucggaaagggcagccuggugaccugcgccaaauuugccugcuccaagaaaaugacagggaagucuauccagccugaaaaccucgaguacagaaucaugcugucuguccacggaucccaacacagcggcaugauugugaaugauaccgggcaugaaacggacgagaaccgggcuaagguugagaucacacccaauucucccagagcggaagccacccuuggaggcuucggcagccuggggcucgauugugagccucgcaccggacuggacuuuuccgaucuuuauuaccugacaaugaacaauaaacacuggcucgugcauaaggaaugguuccacgacauuccccugccuuggcacgcuggcgccgauaccgggacaccccauuggaacaauaaagaggcccuggucgaauuuaaggacgcucacgccaaacggcagacgguggucgugcucggaucucaggagggcgcgguucauaccgcucuggccggggcccuugaggcugaaauggauggcgccaagggaagacugagcuccggccaccucaaaugccgccugaagauggacaagcugcggcugaaaggggugagcuauucucucuguacagcugccuucaccuuuacaaagaucccggcggagacccugcauggaacggucaccguggaaguucaguacgccggcacagacgggccuugcaaagugcccgcucaaauggccgucgauaugcagacccugacaccugugggaagacucauuaccgcuaaccccgugaucacggaguccacagaaaacagcaagaugaugcuggagcuugacccgccuuucggcgauucuuacaucguuauuggggucggcgagaaaaagaucacccaccacuggcaucgcuccggaagcacaauuggcaaggccuuugaagcgaccgugagaggggccaaacggauggcugugcugggagacaccgccugggauuucggcuccgucgggggagcucucaauucucugggcaaggggauccaccagauuuucggcgccgccuuuaaaagccuguucggaggcauguccugguuuucucaaauccuuaucgggacacuccugauguggcugggacucaacacgaagaauggcagcauuucccugaugugucuugcucuugggggagugcucaucuuccugagcaccgcgguuucugccgacgugggcugcugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8871 - RNA, 2302 nt, Artificial Sequence
  ZIKV prME variant mRNA Design 3 opt
gggagaaagcuuaccaugaccagcgugggcaucgucgggcugcuccugacaacggccauggcugccgagguuaccagacggggauccgcguacuauauguaccuugaccgcaacgaugcuggcgaagccauuucuuuccccacaacccuggggaugaauaagugcuauauccagauuauggaccucggacacaugugugaugccacaaugagcuacgagugcccuaugcuggacgaaggcguggagccggaugacguggauuguuggugcaacaccacauccaccugggucguguaugggacgugucaucacaaaaagggagaagcuagacggucucgcagagccguuacccuucccagccauuccacacggaaacugcaaacccgcucucagacauggcucgagagcagagaguacaccaagcaccugauccggguggaaaauuggauuuuucgcaacccuggcuucgcucuggccgcggccgcuaucgccuggcuccugggcuccagcacgucucagaaagucaucuaucuugugaugauucugcucaucgcucccgccuacuccauuagaugcaucgggguuagcaaucgggacuuuguggagggaaugucuggcgggacaugggucgauauugugcuggaacauggaggcugugugaccgucauggcgcaggacaagccuacaguugauaucgagcuugugaccaccacaguguccaacauggccgagguccgcagcuacugcuaugaagcuagcauuuccgacauggccagcgauuccagaugucccacgcaaggggaggcuuaccuggacaagcagucugacacccaguaugugugcaaacggacacucguugaucgcggauggggcaauggcugugggcuguucggaaagggcagccuggugaccugcgccaaauuugccugcuccaagaaaaugacagggaagucuauccagccugaaaaccucgaguacagaaucaugcugucuguccacggaucccaacacagcggcaugauugugaaugacaccgggcaugaaacggaugagaaccgggcuaagguugagaucacacccaauucuccgagagcggaagccacccuuggaggcuucggcagccuggggcucgacugugagccucgcaccggacuggauuuuuccgaccuuuauuaccugacaaugaacaauaaacacuggcucgugcauaaggaaugguuccacgauauuccccugccuuggcacgcuggcgccgacaccgggacaccccauuggaacaauaaagaggcccuggucgaauuuaaggaugcucacgccaaacggcagacgguggucgugcucggaucucaggagggcgcgguucauaccgcucuggccggggcccuugaggcugaaauggacggcgccaagggaagacugagcuccggccaccucaaaugccgccugaagauggauaagcugcggcugaaaggggugagcuauucucucuguacagcugccuucaccuuuacaaagaucccggcggagacccugcauggaacggucaccguggaaguucaguacgccggcacagacgggccuugcaaagugcccgcucaaauggccgucgacaugcagacccugacaccugugggaagacucauuaccgcuaaccccgugaucacggaguccacagaaaacagcaagaugaugcuggagcuugaucccccuuucggcgacucuuacaucguuauuggggucggcgagaaaaagaucacccaccacuggcaucgcuccggaagcacaauuggcaaggccuuugaagcgaccgugagaggggccaaacggauggcugugcugggagauaccgccugggacuucggcuccgucgggggagcucucaauucucugggcaaggggauccaccagauuuucggcgccgccuuuaaaagccuguucggaggcauguccugguuuucucaaauccuuaucgggacacuccugauguggcugggacucaacacgaagaauggcagcauuucccugaugugucuugcucuugggggagugcucaucuuccugagcaccgcgguuucugccgaugugggcugcugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8872 - RNA, 2302 nt, Artificial Sequence
  ZIKV prME variant mRNA Design 3 opt
gggagaaagcuuaccaugaccagcgugggcaucgucgggcugcuccugacaacggccauggcugccgcgguuaccagacggggauccgcuuacuauauguaccuugaccgcaacgaugccggcgaggccauuucuuuccccacaacccuggggaugaauaagugcuauauccagauuauggaccucggacacaugugugaugcuacaaugagcuacgaaugcccuaugcuggacgagggcguggaaccggaugacguggauuguuggugcaacaccacauccaccugggucguguaugggacgugucaucacaaaaagggagaggccagacggucucgcagagcuguuacccuucccagccauuccacacggaaacugcaaacccgcucucagacauggcucgaaagcagagaguacaccaagcaccugauccggguggagaauuggauuuuucgcaacccuggcuucgcccuggcggccgcugccaucgcuuggcuccugggcuccagcacgucucagaaagucaucuaucuugugaugauucugcucaucgcccccgcguacuccauuagaugcaucgggguuagcaaucgggacuuuguggaaggaaugucuggcgggacaugggucgauauugugcuggagcauggaggcugugugaccgucauggcccaggacaagccuacaguugauaucgaacuugugaccaccacaguguccaacauggcugagguccgcagcuacugcuaugaggccucuauuuccgacauggcuagcgauuccagaugucccacgcaaggggaagccuaccuggacaagcagucugacacccaguaugugugcaaacggacacucguugaucgcggauggggcaauggcugugggcuguucggaaagggcagccuggugaccugcgccaaauuugcuugcuccaagaaaaugacagggaagucuauccagccugagaaccucgaauacagaaucaugcugucuguccacggaucccaacacagcggcaugauugugaaugacaccgggcaugagacggaugaaaaccgggcgaagguugagaucacaccgaauagccccagagccgaggcuacccuuggaggcuucggcagccuggggcucgacugugaaccucgcaccggacuggauuuuuccgaccuuuauuaccugacaaugaacaauaaacacuggcucgugcauaaggagugguuccacgauauuccccugccuuggcacgccggcgccgacaccgggacaccccauuggaacaauaaagaagcucuggucgaguuuaaggaugcccacgcgaaacggcagacgguggucgugcucggaucucaggaaggcgcuguucauaccgcccuggccggggcucuugaggccgagauggacggcgcuaagggaagacugagcuccggccaccucaaaugccgccugaagauggauaagcugcggcugaaaggggugagcuauucucucuguacagccgcguucaccuuuacaaagaucccggccgaaacccugcauggaacggucaccguggagguucaguacgcuggcacagacgggccuugcaaagugcccgcccaaauggcugucgacaugcagacccugacaccugugggaagacucauuaccgccaaccccgugaucacggaauccacagagaacagcaagaugaugcuggaacuugaucccccuuucggcgacucuuacaucguuauuggggucggcgagaaaaagaucacccaccacuggcaucgcuccggaagcacaauuggcaaggcguuugaggccaccgugagaggggcuaaacggauggccgugcugggagauaccgcuugggacuucggcuccgucgggggagcccucaauucucugggcaaggggauccaccagauuuucggcgccgcuuuuaaaagccuguucggaggcauguccugguuuucucaaauccuuaucgggacacuccugauguggcugggacucaacacgaagaauggcagcauuucccugaugugucuugcgcuugggggagugcucaucuuccugagcaccgccguuucugcugaugugggcugcugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8873 - RNA, 2314 nt, Artificial Sequence
  ZIKV prME variant mRNA Design 3 opt
gggagaaagcuuaccaugagaggcgccgacaccagcguggggaucgucggacugcuccugacaacggcuauggccgcggcuguuacccggcgcggcuccgccuacuauauguaccuugauagaaacgacgccggggaggcuauuucuuuccccacaacccugggaaugaauaagugcuauauccagauuauggaucucggccacaugugugacgccacaaugagcuacgaaugcccuaugcuggaugaggggguggaaccggacgauguggacuguuggugcaacaccacauccaccugggucguguauggaacgugucaucacaaaaagggcgaggcucggcgcucuagacgggccguuacccuucccagccauuccacacgcaaacugcaaaccagaucucagacauggcucgaaagccgggaguacaccaagcaccugauccgcguggagaauuggauuuuuagaaacccuggcuucgcgcuggccgcugccgcuaucgccuggcuccugggguccagcacgucucagaaagucaucuaucuugugaugauucugcucaucgcgcccgccuacuccauucggugcaucggaguuagcaaucgcgauuuuguggaaggcaugucugggggaacaugggucgacauugugcuggagcauggcgggugugugaccgucauggcucaggauaagccuacaguugacaucgaacuugugaccaccacaguguccaacauggccgaggucagaagcuacugcuaugaggcuucuauuuccgauauggccagcgacucccggugucccacgcaaggagaagccuaccuggacaagcagucugauacccaguaugugugcaaacgcacacucguugacagaggcuggggcaauggguguggacuguucggcaaggggagccuggugaccugcgcuaaauuugcgugcuccaagaaaaugacaggaaagagcauccagccugagaaccucgaauaccggaucaugcugucuguccacggcucccaacacagcgggaugauugugaaugauaccggacaugagacggacgaaaacagagccaagguugagaucacacccaauucuccccgcgcugaggccacccuuggcggcuucgggagccugggacucgauugugaaccucggaccggccuggacuuuuccgaucuuuauuaccugacaaugaacaauaaacacuggcucgugcauaaggagugguuccacgacauuccccugccuuggcacgccggggcugauaccggaacaccccauuggaacaauaaagaagcccuggucgaguuuaaggacgcgcacgcuaaaagacagacgguggucgugcucggcucucaggaaggggccguucauaccgcccuggcuggcgcccuugaggcugagauggauggagccaagggccgccugagcuccgggcaccucaaaugccggcugaagauggacaaacuuagacugaagggagugagcuauucucucuguacagcggccuucaccuuuacaaagaucccggcugaaacccugcauggcacggucaccguggagguucaguacgccgggacagacggaccuugcaaagugcccgcucaaauggccgucgauaugcagacccugacaccugugggccgccucauuaccgcgaaccccgugaucacggaauccacagagaacagcaagaugaugcuggaacuugacccgccuuucggggauucuuacaucguuauuggcgucggagagaaaaagaucacccaccacuggcaucgguccggcagcacaauugggaaggccuuugaggcuaccgugagaggagccaaacgcauggcugugcugggcgacaccgccugggauuucggguccgucggaggcgcccucaauucucuggggaagggcauccaccagauuuucggagcugcguuuaaaagccuguucggcgggauguccugguuuucucaaauccuuaucggaacacuccugauguggcugggccucaacacgaagaaugggagcauuucccugaugugucuugcccugggaggcgugcucaucuuccugagcaccgcuguuucugccgacguggggugcugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8874 - RNA, 2338 nt, Artificial Sequence
  ZIKV prME variant mRNA Design 3 opt
gggagaaagcuuaccaugagaggccugagcucccggaagcgcagaucucacgacgugcucaccguccaguuccugauccuugggaugcugcucaugacaggaggcguuacgcggcgcgggagcgccuacuauauguaccuggauagaaacgacgcuggagaggccauuuccuuucccaccacacuuggcaugaauaaaugcuauauccaaauuauggaucuggggcauaugugugacgcgaccaugucuuacgaaugcccuaugcucgaugagggaguggaaccggacgauguggacuguuggugcaacacaaccagcacaugggucguguauggcaccugucaccauaagaaaggcgaggcucggcgcuccagacgggccguuacgcugcccucucacagcacccgcaagcugcagacaagaucccagaccuggcucgaaagccgggaguacacaaaacaucugauccgcguggagaauuggauuuucagaaacccuggguuugcccuugcugccgcugccaucgcguggcugcucggaucuuccaccagccagaaggucaucuaucuggugaugauucuucugaucgcccccgcuuacucuauucggugcaucggcguuuccaaucgcgauuucguggaagggaugagcggaggcacgugggucgacauugugcucgagcacgggggaugugugacagucauggcccaagauaagccuaccguugacaucgaacuggugacaaccaccgugucuaacauggcugaggucagauccuacugcuaugaggccagcauuuccgauauggcgucugacagccggugucccacacagggcgaagccuaccuggacaaacaguccgauacgcaguaugugugcaagagaacccucguugaccgcggcugggggaauggauguggccuguuugggaaaggaagccuugugacaugcgcuaaguucgccugcucuaaaaagaugaccggcaaguccauccaaccugagaaccuggaauaccggaucaugcucagcguccacgggucucagcauagcggaaugauugugaaugauacaggccacgagaccgacgaaaacagagcuaaaguugagaucacgcccaauuccccgcgcgccgaggccacacugggcggguuuggaucucuuggccuggauugugaaccucggaccgggcucgacuucagcgaucuguauuaccugaccaugaacaauaagcauuggcucgugcacaaagagugguuucacgacauuccccugccuuggcaugcuggagcggauacaggcacaccccacuggaacaauaaggaagcccuugucgaguucaaagacgcucaugccaagagacagacaguggucgugcuggggucccaggaaggcgccguucacacggcucucgccggagcgcuggaggcugagauggauggcgccaaagggcgccuuagcucuggacaucugaagugccggcucaagauggacaaacugagacugaagggcguguccuauagccucuguaccgccgcuuuuacauucaccaaaaucccggccgaaacacugcacgggaccgucacgguggagguucaauacgcuggaaccgacggcccuugcaaggugcccgcccagauggcggucgauaugcagacacuuaccccuguggggcgccugauuacagccaaccccgugaucaccgaaucuacggagaacuccaaaaugaugcucgaacuggaucccccuuuuggcgacagcuacaucguuauuggagucggcgagaagaagaucacacaccauuggcaccgguccgggucuaccauuggaaaggcuuucgaggccacagugagaggcgcuaaacgcauggccgugcugggggacaccgcgugggauuucggaagcgucggcggggcccuuaauucccucggcaaaggaauccaucaaauuuuuggcgcugccuucaagucucuguuugggggaaugagcugguucucccagauccugaucggcacccuccugauguggcuugggcugaacaccaaaaauggaagcauuucucucaugugucuggcucugggcggggugcuuaucuuucucuccacggccguuagcgccgacgugggcugcugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8875 - RNA, 2338 nt, Artificial Sequence
  ZIKV prME variant mRNA Design 3 opt
gggagaaagcuuaccaugagaggccugagcucccggaagcgcagaucucacgacgugcucaccguccaguuccugauccuugggaugcugcucaugacaggagccguuacgcggcgcggcagcgcuuacuauauguaccuggauagaaacgacgccggggaggcgauuuccuuucccaccacacuuggaaugaauaaaugcuauauccaaauuauggaucugggccauaugugugacgcuaccaugucuuacgaaugcccuaugcucgaugaggggguggaaccggacgauguggacuguuggugcaacacaaccagcacaugggucguguauggaaccugucaccauaagaaaggcgaggcccggcgcuccagacgggccguuacgcugcccucucacagcacccgcaagcugcagacaagaucccagaccuggcucgaaagccgggaguacacaaaacaucugauccgcguggagaauuggauuuucagaaacccuggcuuugcucuugccgcugccgcgaucgccuggcugcucgggucuuccaccagccagaaggucaucuaucuggugaugauucuucugaucgcucccgccuacucuauucggugcaucggaguuuccaaucgcgauuucguggaaggcaugagcgggggaacgugggucgacauugugcucgagcacggcgggugugugacagucauggcucaagauaagccuaccguugacaucgaacuggugacaaccaccgugucuaacauggccgaggucagauccuacugcuaugaggcgagcauuuccgauauggccucugacagccggugucccacacagggagaggcuuaccuggacaaacaguccgauacgcaguaugugugcaagagaacccucguugaccgcggcuggggcaauggguguggacuguuuggcaaagggagccuugugacaugcgccaaguucgcuugcucuaaaaagaugaccggaaaguccauccaaccugaaaaccuggaauaccggaucaugcucagcguccacggcucucagcauagcgggaugauugugaaugauacaggacacgagaccgacgaaaacagagccaaaguugagaucacgcccaauuccccgcgcgccgaggcuacacugggcggcuuugggucucuuggacuggauugugaaccucggaccggccucgacuucagcgaucuguauuaccugaccaugaacaauaagcauuggcucgugcacaaagagugguuucacgacauuccccugccuuggcaugcgggggccgauacaggaacaccccacuggaacaauaaggaagcucuugucgaguucaaagacgcccaugccaagagacagacaguggucgugcugggcucccaggaaggggcuguucacacggcccucgcgggcgcucuggaggccgagauggauggagccaaaggccgccuuagcucugggcaucugaagugccggcucaagauggacaaacugagacugaagggaguguccuauagccucuguaccgcugccuuuacauucaccaaaaucccggcugaaacacugcacggcaccgucacgguggagguucaauacgccgggaccgacggaccuugcaaggugcccgcgcagauggccgucgauaugcagacacuuaccccugugggccgccugauuacagcuaaccccgugaucaccgaaucuacggagaacuccaaaaugaugcucgaacuggaucccccuuuuggggacagcuacaucguuauuggcgucggagagaagaagaucacacaccauuggcaccgguccggcucuaccauugggaaagccuucgaggcuacagugagaggagccaagcgcauggcggugcugggcgacaccgccugggauuucgggagcgucggaggcgcucuuaauucccucgggaaaggcauccaucaaauuuuuggagccgcuuucaagucucuguuuggcgggaugagcugguucucccagauccugaucggaacccuccugauguggcuuggccugaacaccaaaaaugggagcauuucucucaugugucuggcccugggaggcgugcuuaucuuucucuccacggccguuagcgcugacguggggugcugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8876 - RNA, 2338 nt, Artificial Sequence
  ZIKV prME variant mRNA Design 3 opt
gggagaaagcuuaccaugagaaucauuaacgcccggaaggagaaaaagcgcagaggcgcugacaccagcguggggaucgucggacugcuccugacaacggccauggcggcugaaguuacccggcgcggcuccgccuacuauauguaccuugauagaaaugacgccggggaggcuauuucuuuccccacaacccugggaaugaacaaaugcuauauccagauuauggaucucggccacaugugugacgccacaaugagcuacgaaugcccuaugcuggaugaggggguggaaccggacgauguggacuguuggugcaauaccacauccaccugggucguguauggaacgugucaucacaagaaaggcgaggcucggcgcucuagacgggccguuacccuucccagccauuccacacgcaagcugcaaaccagaucucagacauggcucgagagccgggaauacaccaagcaccugauccgcguggagaacuggaucuuuagaaauccuggcuucgcgcuggccgcugccgcuauugccuggcuccugggguccagcacgucucagaaagucaucuaucuugugaugauucugcucaucgcgcccgccuacuccauucggugcaucggaguuagcaaccgcgauuuuguggaaggcaugucugggggaacaugggucgacauugugcuggagcauggcgggugugugaccgucauggcucaggauaagccuacaguugacaucgagcuugugaccaccacaguguccaauauggccgaagucagaagcuacugcuaugaggcuucuaucuccgauauggccagcgacucccggugucccacgcaaggagaagccuaccuggacaaacagucugauacccaguaugugugcaagagaacacucguugaccgcggcuggggcaacggguguggacuguucggcaaagggagccuggugaccugcgcuaaguuugcgugcuccaagaaaaugacaggaaagagcauucagccugagaaucucgaauaccggaucaugcugucuguccacggcucccaacacagcgggaugauugugaacgauaccggacaugagacggacgagaauagagccaaaguugaaaucacaccgaacucuccccgcgcugaggccacccuuggcggcuucgggagccugggacucgauugugaaccucggaccggccuggacuuuuccgaucuuuauuaccugacaaugaauaacaagcacuggcucgugcauaaagagugguuccacgacauuccccugccuuggcacgccggggcugauaccggaacaccccauuggaauaacaaggaagcccuggucgaguuuaaagacgcgcacgcuaagagacagacgguggucgugcucggcucucaggagggggccguucauaccgcccuggcuggcgcccuugaagcugagauggauggagccaagggccgccugagcuccgggcaccucaaaugccggcugaagauggacaaacuuagacugaagggagugagcuauucucucuguacagcggccuucaccuuuacaaaaaucccggcugaaacccugcauggcacggucaccguggagguucaguacgccgggacagacggaccuugcaaggugcccgcucaaauggccgucgauaugcagacccugacaccugugggccgccucaucaccgcgaaccccgugauuacggaauccacagagaauagcaagaugaugcuggagcuugaucccccuuucggggacucuuacaucguuauuggcgucggagagaaaaagaucacccaccacuggcaucgguccggcagcacaauugggaaagccuuugaagcuaccgugagaggagccaagcgcauggcugugcugggcgacaccgccugggauuucggguccgucggaggcgcccucaacucucuggggaaaggcauccaccagaucuucggagcugcguuuaagagccuguucggcgggauguccugguuuucucaaauucuuaucggaacacuccugauguggcugggccucaauacgaagaacgggagcauuucccugaugugucuugcccugggaggcgugcucaucuuccugagcaccgcuguuucugccgacugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8877 - RNA, 2335 nt, Artificial Sequence
  ZIKV prME variant mRNA Design 3 opt
gggagaaagcuuaccaugaucauuaacgccagaaaggagaaaaagcggcgcggcgcugacaccagcguggggaucgucggacugcuccugacaacggccauggcggcugaaguuaccagacggggcuccgccuacuauauguaccuugaucgcaaugacgccggggaggcuauuucuuuccccacaacccugggaaugaacaaaugcuauauccagauuauggaucucggccacaugugugacgccacaaugagcuacgaaugcccuaugcuggaugaggggguggaaccggacgauguggacuguuggugcaauaccacauccaccugggucguguauggaacgugucaucacaagaaaggcgaggcuagacggucucgcagagccguuacccuucccagccauuccacacggaagcugcaaacccgcucucagacauggcucgagagcagagaauacaccaagcaccugauccggguggagaacuggaucuuucgcaauccuggcuucgcgcuggccgcugccgcuauugccuggcuccugggguccagcacgucucagaaagucaucuaucuugugaugauucugcucaucgcgcccgccuacuccauuagaugcaucggaguuagcaaccgggauuuuguggaaggcaugucugggggaacaugggucgacauugugcuggagcauggcgggugugugaccgucauggcucaggauaagccuacaguugacaucgagcuugugaccaccacaguguccaauauggccgaaguccgcagcuacugcuaugaggcuucuaucuccgauauggccagcgacuccagaugucccacgcaaggagaagccuaccuggacaaacagucugauacccaguaugugugcaagcggacacucguugacagaggcuggggcaacggguguggacuguucggcaaagggagccuggugaccugcgcuaaguuugcgugcuccaagaaaaugacaggaaagagcauucagccugagaaucucgaauaccgcaucaugcugucuguccacggcucccaacacagcgggaugauugugaacgauaccggacaugagacggacgagaaucgggccaaaguugaaaucacaccgaacucucccagagcugaggccacccuuggcggcuucgggagccugggacucgauugugaaccucgcaccggccuggacuuuuccgaucuuuauuaccugacaaugaauaacaagcacuggcucgugcauaaagagugguuccacgacauuccccugccuuggcacgccggggcugauaccggaacaccccauuggaauaacaaggaagcccuggucgaguuuaaagacgcgcacgcuaagcggcagacgguggucgugcucggcucucaggagggggccguucauaccgcccuggcuggcgcccuugaagcugagauggauggagccaagggcagacugagcuccgggcaccucaaaugccgccugaagauggacaaacuucggcugaagggagugagcuauucucucuguacagcggccuucaccuuuacaaaaaucccggcugaaacccugcauggcacggucaccguggagguucaguacgccgggacagacggaccuugcaaggugcccgcucaaauggccgucgauaugcagacccugacaccugugggcagacucaucaccgcgaaccccgugauuacggaauccacagagaauagcaagaugaugcuggagcuugaucccccuuucggggacucuuacaucguuauuggcgucggagagaaaaagaucacccaccacuggcaucgcuccggcagcacaauugggaaagccuuugaagcuaccgugcggggagccaagagaauggcugugcugggcgacaccgccugggauuucggguccgucggaggcgcccucaacucucuggggaaaggcauccaccagaucuucggagcugcguuuaagagccuguucggcgggauguccugguuuucucaaauucuuaucggaacacuccugauguggcugggccucaauacgaagaacgggagcauuucccugaugugucuugcccugggaggcgugcucaucuuccugagcaccgcuguuucugccgacugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8878 - RNA, 2332 nt, Artificial Sequence
  ZIKV prME variant mRNA Design 3 opt
gggagaaagcuuaccaugaucaacgccagaaaggagaaaaagcggcgcggcgcugacaccagcguggggauugucggacugcuccugacaacggccauggcggcugaaguuaccagacggggcuccgccuacuauauguaccuugaucgcaaugacgccggggaggcuaucucuuuccccacaacccugggaaugaacaaaugcuauauucagaucauggaucucggccacaugugugacgccacaaugagcuacgaaugcccuaugcuggaugaggggguggaaccggacgauguggacuguuggugcaauaccacauccaccugggucguguauggaacgugucaucacaagaaaggcgaggcuagacggucucgcagagccguuacccuucccagccauuccacacggaagcugcaaacccgcucucagacauggcucgagagcagagaauacaccaagcaccugauucggguggagaacuggaucuuucgcaauccuggcuucgcgcuggccgcugccgcuaucgccuggcuccugggguccagcacgucucagaaagucauuuaucuugugaugauccugcucauugcgcccgccuacuccaucagaugcauuggaguuagcaaccgggauuuuguggaaggcaugucugggggaacaugggucgacaucgugcuggagcauggcgggugugugaccgucauggcucaggauaagccuacaguugacauugagcuugugaccaccacaguguccaauauggccgaaguccgcagcuacugcuaugaggcuucuaucuccgauauggccagcgacuccagaugucccacgcaaggagaagccuaccuggacaaacagucugauacccaguaugugugcaagcggacacucguugacagaggcuggggcaacggguguggacuguucggcaaagggagccuggugaccugcgcuaaguuugcgugcuccaagaaaaugacaggaaagagcauccagccugagaaucucgaauaccgcauuaugcugucuguccacggcucccaacacagcgggaugaucgugaacgauaccggacaugagacggacgagaaucgggccaaaguugaaauuacaccgaacucucccagagcugaggccacccuuggcggcuucgggagccugggacucgauugugaaccucgcaccggccuggacuuuuccgaucuuuauuaccugacaaugaauaacaagcacuggcucgugcauaaagagugguuccacgacaucccccugccuuggcacgccggggcugauaccggaacaccccauuggaauaacaaggaagcccuggucgaguuuaaagacgcgcacgcuaagcggcagacgguggucgugcucggcucucaggagggggccguucauaccgcccuggcuggcgcccuugaagcugagauggauggagccaagggcagacugagcuccgggcaccucaaaugccgccugaagauggacaaacuucggcugaagggagugagcuauucucucuguacagcggccuucaccuuuacaaaaauuccggcugaaacccugcauggcacggucaccguggagguucaguacgccgggacagacggaccuugcaaggugcccgcucaaauggccgucgauaugcagacccugacaccugugggcagacucaucaccgcgaaccccgugaucacggaauccacagagaauagcaagaugaugcuggagcuugaucccccuuucggggacucuuacauuguuaucggcgucggagagaaaaagauuacccaccacuggcaucgcuccggcagcacaaucgggaaagccuuugaagcuaccgugcggggagccaagagaauggcugugcugggcgacaccgccugggauuucggguccgucggaggcgcccucaacucucuggggaaaggcauucaccagaucuucggagcugcguuuaagagccuguucggcgggauguccugguuuucucaaauccuuauuggaacacuccugauguggcugggccucaauacgaagaacgggagcaucucccugaugugucuugcccugggaggcgugcucauuuuccugagcaccgcuguuucugccgacugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8879 - RNA, 2329 nt, Artificial Sequence
  ZIKV prME variant mRNA Design 3 opt
gggagaaagcuuaccaugaacgccagaaaggagaaaaagcggcgcggcgcugacaccagcguggggaucgucggacugcuccugacaacggccauggcggcugaaguuaccagacggggcuccgccuacuauauguaccuugaucgcaaugacgccggggaggcuauuucuuuccccacaacccugggaaugaacaaaugcuauauccagauuauggaucucggccacaugugugacgccacaaugagcuacgaaugcccuaugcuggaugaggggguggaaccggacgauguggacuguuggugcaauaccacauccaccugggucguguauggaacgugucaucacaagaaaggcgaggcuagacggucucgcagagccguuacccuucccagccauuccacacggaagcugcaaacccgcucucagacauggcucgagagcagagaauacaccaagcaccugauccggguggagaacuggauuuuucgcaauccuggcuucgcgcuggccgcugccgcuaucgccuggcuccugggguccagcacgucucagaaagucaucuaucuugugaugauucugcucaucgcgcccgccuacuccauuagaugcaucggaguuagcaaccgggauuuuguggaaggcaugucugggggaacaugggucgacauugugcuggagcauggcgggugugugaccgucauggcucaggauaagccuacaguugacaucgagcuugugaccaccacaguguccaauauggccgaaguccgcagcuacugcuaugaggcuucuauuuccgauauggccagcgacuccagaugucccacgcaaggagaagccuaccuggacaaacagucugauacccaguaugugugcaagcggacacucguugacagaggcuggggcaacggguguggacuguucggcaaagggagccuggugaccugcgcuaaguuugcgugcuccaagaaaaugacaggaaagagcauccagccugagaaucucgaauaccgcaucaugcugucuguccacggcucccaacacagcgggaugauugugaacgauaccggacaugagacggacgagaaucgggccaaaguugaaaucacaccgaacucucccagagcugaggccacccuuggcggcuucgggagccugggacucgauugugaaccucgcaccggccuggacuuuuccgaucuuuauuaccugacaaugaauaacaagcacuggcucgugcauaaagagugguuccacgacauuccccugccuuggcacgccggggcugauaccggaacaccccauuggaauaacaaggaagcccuggucgaguuuaaagacgcgcacgcuaagcggcagacgguggucgugcucggcucucaggagggggccguucauaccgcccuggcuggcgcccuugaagcugagauggauggagccaagggcagacugagcuccgggcaccucaaaugccgccugaagauggacaaacuucggcugaagggagugagcuauucucucuguacagcggccuucaccuuuacaaaaaucccggcugaaacccugcauggcacggucaccguggagguucaguacgccgggacagacggaccuugcaaggugcccgcucaaauggccgucgauaugcagacccugacaccugugggcagacucauuaccgcgaaccccgugaucacggaauccacagagaauagcaagaugaugcuggagcuugaucccccuuucggggacucuuacaucguuauuggcgucggagagaaaaagaucacccaccacuggcaucgcuccggcagcacaauugggaaagccuuugaagcuaccgugcggggagccaagagaauggcugugcugggcgacaccgccugggauuucggguccgucggaggcgcccucaacucucuggggaaaggcauccaccagauuuucggagcugcguuuaagagccuguucggcgggauguccugguuuucucaaauccuuaucggaacacuccugauguggcugggccucaauacgaagaacgggagcauuucccugaugugucuugcccugggaggcgugcucaucuuccugagcaccgcuguuucugccgacugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8880 - RNA, 2326 nt, Artificial Sequence
  ZIKV prME variant mRNA Design 3 opt
gggagaaagcuuaccauggccagaaaggagaaaaagcggcgcggcgcugacaccagcguggggaucgucggacugcuccugacaacggccauggcggcugaaguuaccagacggggcuccgccuacuauauguaccuugaucgcaacgacgccggggaggcuauuucuuuccccacaacccugggaaugaauaaaugcuauauccagauuauggaucucggccacaugugugacgccacaaugagcuacgaaugcccuaugcuggaugaggggguggaaccggacgauguggacuguuggugcaacaccacauccaccugggucguguauggaacgugucaucacaagaaaggcgaggcuagacggucucgcagagccguuacccuucccagccauuccacacggaagcugcaaacccgcucucagacauggcucgagagcagagaauacaccaagcaccugauccggguggagaauuggauuuuucgcaacccuggcuucgcgcuggccgcugccgcuaucgccuggcuccugggguccagcacgucucagaaagucaucuaucuugugaugauucugcucaucgcgcccgccuacuccauuagaugcaucggaguuagcaaucgggauuuuguggaaggcaugucugggggaacaugggucgacauugugcuggagcauggcgggugugugaccgucauggcucaggauaagccuacaguugacaucgagcuugugaccaccacaguguccaacauggccgaaguccgcagcuacugcuaugaggcuucuauuuccgauauggccagcgacuccagaugucccacgcaaggagaagccuaccuggacaaacagucugauacccaguaugugugcaagcggacacucguugacagaggcuggggcaauggguguggacuguucggcaaagggagccuggugaccugcgcuaaguuugcgugcuccaagaaaaugacaggaaagagcauccagccugagaaccucgaauaccgcaucaugcugucuguccacggcucccaacacagcgggaugauugugaaugauaccggacaugagacggacgagaaccgggccaaaguugaaaucacacccaauucucccagagcugaggccacccuuggcggcuucgggagccugggacucgauugugaaccucgcaccggccuggacuuuuccgaucuuuauuaccugacaaugaacaauaagcacuggcucgugcauaaagagugguuccacgacauuccccugccuuggcacgccggggcugauaccggaacaccccauuggaacaauaaggaagcccuggucgaguuuaaagacgcgcacgcuaagcggcagacgguggucgugcucggcucucaggagggggccguucauaccgcccuggcuggcgcccuugaagcugagauggauggagccaagggcagacugagcuccgggcaccucaaaugccgccugaagauggacaaacuucggcugaagggagugagcuauucucucuguacagcggccuucaccuuuacaaaaaucccggcugaaacccugcauggcacggucaccguggagguucaguacgccgggacagacggaccuugcaaggugcccgcucaaauggccgucgauaugcagacccugacaccugugggcagacucauuaccgcgaaccccgugaucacggaauccacagagaacagcaagaugaugcuggagcuugacccgccuuucggggauucuuacaucguuauuggcgucggagagaaaaagaucacccaccacuggcaucgcuccggcagcacaauugggaaagccuuugaagcuaccgugcggggagccaagagaauggcugugcugggcgacaccgccugggauuucggguccgucggaggcgcccucaauucucuggggaaaggcauccaccagauuuucggagcugcguuuaagagccuguucggcgggauguccugguuuucucaaauccuuaucggaacacuccugauguggcugggccucaacacgaagaaugggagcauuucccugaugugucuugcccugggaggcgugcucaucuuccugagcaccgcuguuucugccgacugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8881 - RNA, 2323 nt, Artificial Sequence
  ZIKV prME variant mRNA Design 3 opt
gggagaaagcuuaccaugagaaaggagaaaaagcggcgcggcgccgacaccagcguggggaucgucggacugcuccugacaacggcuauggccgcggaaguuaccagacggggcuccgcuuacuauauguaccuugaucgcaacgacgccggggaggccauuucuuuccccacaacccugggaaugaauaaaugcuauauccagauuauggaucucggccacaugugugacgcuacaaugagcuacgaaugcccuaugcuggaugaggggguggaaccggacgauguggacuguuggugcaacaccacauccaccugggucguguauggaacgugucaucacaagaaaggcgaggccagacggucucgcagagcuguuacccuucccagccauuccacacggaagcugcaaacccgcucucagacauggcucgagagcagagaauacaccaagcaccugauccggguggagaauuggauuuuucgcaacccuggcuucgcccuggcggccgcugccaucgcuuggcuccugggguccagcacgucucagaaagucaucuaucuugugaugauucugcucaucgcccccgcguacuccauuagaugcaucggaguuagcaaucgggauuuuguggaaggcaugucugggggaacaugggucgacauugugcuggagcauggcgggugugugaccgucauggcccaggauaagccuacaguugacaucgagcuugugaccaccacaguguccaacauggcugaaguccgcagcuacugcuaugaggccucuauuuccgauauggcuagcgacuccagaugucccacgcaaggagaagccuaccuggacaaacagucugauacccaguaugugugcaagcggacacucguugacagaggcuggggcaauggguguggacuguucggcaaagggagccuggugaccugcgccaaguuugcuugcuccaagaaaaugacaggaaagagcauccagccugagaaccucgaauaccgcaucaugcugucuguccacggcucccaacacagcgggaugauugugaaugauaccggacaugagacggacgagaaccgggcgaaaguugaaaucacacccaauucucccagagccgaggcuacccuuggcggcuucgggagccugggacucgauugugaaccucgcaccggccuggacuuuuccgaucuuuauuaccugacaaugaacaauaagcacuggcucgugcauaaagagugguuccacgacauuccccugccuuggcacgccggggccgauaccggaacaccccauuggaacaauaaggaagcucuggucgaguuuaaagacgcccacgcgaagcggcagacgguggucgugcucggcucucaggagggggcuguucauaccgcccuggccggcgcucuugaagccgagauggauggagcuaagggcagacugagcuccgggcaccucaaaugccgccugaagauggacaaacuucggcugaagggagugagcuauucucucuguacagccgcguucaccuuuacaaaaaucccggccgaaacccugcauggcacggucaccguggagguucaguacgcugggacagacggaccuugcaaggugcccgcccaaauggcugucgauaugcagacccugacaccugugggcagacucauuaccgccaaccccgugaucacggaauccacagagaacagcaagaugaugcuggagcuugacccgccuuucggggauucuuacaucguuauuggcgucggagagaaaaagaucacccaccacuggcaucgcuccggcagcacaauugggaaagcguuugaagccaccgugcggggagcuaagagaauggccgugcugggcgacaccgcuugggauuucggguccgucggaggcgcccucaauucucuggggaaaggcauccaccagauuuucggagccgcuuuuaagagccuguucggcgggauguccugguuuucucaaauccuuaucggaacacuccugauguggcugggccucaacacgaagaaugggagcauuucccugaugugucuugcgcugggaggcgugcucaucuuccugagcaccgccguuucugcugacugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8882 - RNA, 2320 nt, Artificial Sequence
  ZIKV prME variant mRNA Design 3 opt
gggagaaagcuuaccaugaaggagaaaaagagacggggcgccgacaccagcguggggaucgucggacugcuccugacaacggcuauggccgcggaaguuacccgcagaggcuccgcuuacuauauguaccuugaucggaacgacgccggggaggccauuucuuuccccacaacccugggaaugaauaaaugcuauauccagauuauggaucucggccacaugugugacgcuacaaugagcuacgaaugcccuaugcuggaugaggggguggaaccggacgauguggacuguuggugcaacaccacauccaccugggucguguauggaacgugucaucacaagaaaggcgaggcccgcagaucucggcgcgcuguuacccuucccagccauuccacaagaaagcugcaaacccggucucagacauggcucgagagccgcgaauacaccaagcaccugaucagaguggagaauuggauuuuucggaacccuggcuucgcccuggcggccgcugccaucgcuuggcuccugggguccagcacgucucagaaagucaucuaucuugugaugauucugcucaucgcccccgcguacuccauucgcugcaucggaguuagcaauagagauuuuguggaaggcaugucugggggaacaugggucgacauugugcuggagcauggcgggugugugaccgucauggcccaggauaagccuacaguugacaucgagcuugugaccaccacaguguccaacauggcugaaguccggagcuacugcuaugaggccucuauuuccgauauggcuagcgacucccgcugucccacgcaaggagaagccuaccuggacaaacagucugauacccaguaugugugcaagagaacacucguugaccggggcuggggcaauggguguggacuguucggcaaagggagccuggugaccugcgccaaguuugcuugcuccaagaaaaugacaggaaagagcauccagccugagaaccucgaauacagaaucaugcugucuguccacggcucccaacacagcgggaugauugugaaugauaccggacaugagacggacgagaaccgcgcgaaaguugaaaucacacccaauucuccccgggccgaggcuacccuuggcggcuucgggagccugggacucgauugugaaccuagaaccggccuggacuuuuccgaucuuuauuaccugacaaugaacaauaagcacuggcucgugcauaaagagugguuccacgacauuccccugccuuggcacgccggggccgauaccggaacaccccauuggaacaauaaggaagcucuggucgaguuuaaagacgcccacgcgaagcgccagacgguggucgugcucggcucucaggagggggcuguucauaccgcccuggccggcgcucuugaagccgagauggauggagcuaagggccggcugagcuccgggcaccucaaaugcagacugaagauggacaaacuucgccugaagggagugagcuauucucucuguacagccgcguucaccuuuacaaaaaucccggccgaaacccugcauggcacggucaccguggagguucaguacgcugggacagacggaccuugcaaggugcccgcccaaauggcugucgauaugcagacccugacaccugugggccggcucauuaccgccaaccccgugaucacggaauccacagagaacagcaagaugaugcuggagcuugacccgccuuucggggauucuuacaucguuauuggcgucggagagaaaaagaucacccaccacuggcauagauccggcagcacaauugggaaagcguuugaagccaccgugcgcggagcuaagcggauggccgugcugggcgacaccgcuugggauuucggguccgucggaggcgcccucaauucucuggggaaaggcauccaccagauuuucggagccgcuuuuaagagccuguucggcgggauguccugguuuucucaaauccuuaucggaacacuccugauguggcugggccucaacacgaagaaugggagcauuucccugaugugucuugcgcugggaggcgugcucaucuuccugagcaccgccguuucugcugacugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8883 - RNA, 2317 nt, Artificial Sequence
  ZIKV prME variant mRNA Design 3 opt
gggagaaagcuuaccauggagaagaaaagacggggcgccgacaccagcguggggaucgucggacugcuccugacaacggcuauggccgcggaaguuacccgcagaggcuccgcuuacuauauguaccuugaucggaacgacgccggggaggccauuucuuuccccacaacccugggaaugaauaagugcuauauccagauuauggaucucggccacaugugugacgcuacaaugagcuacgaaugcccuaugcuggaugaggggguggaaccggacgauguggacuguuggugcaacaccacauccaccugggucguguauggaacgugucaucacaaaaagggcgaggcccgcagaucucggcgcgcuguuacccuucccagccauuccacaagaaaacugcaaacccggucucagacauggcucgagagccgcgaauacaccaagcaccugaucagaguggagaauuggauuuuucggaacccuggcuucgcccuggcggccgcugccaucgcuuggcuccugggguccagcacgucucagaaggucaucuaucuugugaugauucugcucaucgcccccgcguacuccauucgcugcaucggaguuagcaauagagauuuuguggaaggcaugucugggggaacaugggucgacauugugcuggagcauggcgggugugugaccgucauggcccaggauaaaccuacaguugacaucgagcuugugaccaccacaguguccaacauggcugaaguccggagcuacugcuaugaggccucuauuuccgauauggcuagcgacucccgcugucccacgcaaggagaagccuaccuggacaagcagucugauacccaguaugugugcaaaagaacacucguugaccggggcuggggcaauggguguggacuguucggcaaggggagccuggugaccugcgccaaauuugcuugcuccaagaagaugacaggaaaaagcauccagccugagaaccucgaauacagaaucaugcugucuguccacggcucccaacacagcgggaugauugugaaugauaccggacaugagacggacgagaaccgcgcgaagguugaaaucacacccaauucuccccgggccgaggcuacccuuggcggcuucgggagccugggacucgauugugaaccuagaaccggccuggacuuuuccgaucuuuauuaccugacaaugaacaauaaacacuggcucgugcauaaggagugguuccacgacauuccccugccuuggcacgccggggccgauaccggaacaccccauuggaacaauaaagaagcucuggucgaguuuaaggacgcccacgcgaaacgccagacgguggucgugcucggcucucaggagggggcuguucauaccgcccuggccggcgcucuugaagccgagauggauggagcuaagggccggcugagcuccgggcaccucaagugcagacugaaaauggacaaacuucgccugaagggagugagcuauucucucuguacagccgcguucaccuuuacaaagaucccggccgaaacccugcauggcacggucaccguggagguucaguacgcugggacagacggaccuugcaaagugcccgcccaaauggcugucgauaugcagacccugacaccugugggccggcucauuaccgccaaccccgugaucacggaauccacagagaacagcaagaugaugcuggagcuugacccgccuuucggggauucuuacaucguuauuggcgucggagaaaagaaaaucacccaccacuggcauagauccggcagcacaauugggaaggcguuugaggccaccgugcgcggagcuaaacggauggccgugcugggcgacaccgcuugggauuucggguccgucggaggcgcccucaauucucuggggaagggcauccaccagauuuucggagccgcuuuuaaaagccuguucggcgggauguccugguuuucucaaauccuuaucggaacacuccugauguggcugggccucaacacgaagaaugggagcauuucccugaugugucuugcgcugggaggcgugcucaucuuccugagcaccgccguuucugcugacugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8884 - RNA, 2314 nt, Artificial Sequence
  ZIKV prME variant mRNA Design 3 opt
gggagaaagcuuaccaugaagaaaagacggggcgccgacaccagcguggggaucgucggacugcuccugacaacggcuauggccgcggagguuacccgcagaggcuccgcuuacuauauguaccuugaucggaacgacgccggggaagccauuucuuuccccacaacccugggaaugaauaagugcuauauccagauuauggaucucggccacaugugugacgcuacaaugagcuacgagugcccuaugcuggaugaagggguggagccggacgauguggacuguuggugcaacaccacauccaccugggucguguauggaacgugucaucacaaaaagggcgaagcccgcagaucucggcgcgcuguuacccuucccagccauuccacaagaaaacugcaaacccggucucagacauggcucgagagccgcgaguacaccaagcaccugaucagaguggaaaauuggauuuuucggaacccuggcuucgcccuggcggccgcugccaucgcuuggcuccugggguccagcacgucucagaaggucaucuaucuugugaugauucugcucaucgcccccgcguacuccauucgcugcaucggaguuagcaauagagauuuuguggagggcaugucugggggaacaugggucgacauugugcuggaacauggcgggugugugaccgucauggcccaggauaaaccuacaguugacaucgagcuugugaccaccacaguguccaacauggcugagguccggagcuacugcuaugaagccucuauuuccgauauggcuagcgacucccgcugucccacgcaaggagaggccuaccuggacaagcagucugauacccaguaugugugcaaaagaacacucguugaccggggcuggggcaauggguguggacuguucggcaaggggagccuggugaccugcgccaaauuugcuugcuccaagaagaugacaggaaaaagcauccagccugaaaaccucgaguacagaaucaugcugucuguccacggcucccaacacagcgggaugauugugaaugauaccggacaugaaacggacgagaaccgcgcgaagguugagaucacacccaauucuccccgggccgaagcuacccuuggcggcuucgggagccugggacucgauugugagccuagaaccggccuggacuuuuccgaucuuuauuaccugacaaugaacaauaaacacuggcucgugcauaaggaaugguuccacgacauuccccugccuuggcacgccggggccgauaccggaacaccccauuggaacaauaaagaggcucuggucgaauuuaaggacgcccacgcgaaacgccagacgguggucgugcucggcucucaggagggggcuguucauaccgcccuggccggcgcucuugaggccgaaauggauggagcuaagggccggcugagcuccgggcaccucaagugcagacugaaaauggacaaacuucgccugaagggagugagcuauucucucuguacagccgcguucaccuuuacaaagaucccggccgagacccugcauggcacggucaccguggaaguucaguacgcugggacagacggaccuugcaaagugcccgcccaaauggcugucgauaugcagacccugacaccugugggccggcucauuaccgccaaccccgugaucacggaguccacagaaaacagcaagaugaugcuggagcuugacccgccuuucggggauucuuacaucguuauuggcgucggagagaagaaaaucacccaccacuggcauagauccggcagcacaauugggaaggcguuugaagccaccgugcgcggagcuaaacggauggccgugcugggcgacaccgcuugggauuucggguccgucggaggcgcccucaauucucuggggaagggcauccaccagauuuucggagccgcuuuuaaaagccuguucggcgggauguccugguuuucucaaauccuuaucggaacacuccugauguggcugggccucaacacgaagaaugggagcauuucccugaugugucuugcgcugggaggcgugcucaucuuccugagcaccgccguuucugcugacugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8885 - RNA, 2311 nt, Artificial Sequence
  ZIKV prME variant mRNA Design 3 opt
gggagaaagcuuaccaugaagagacggggcgccgacaccagcguggggaucgucggacugcuccugacaacggcuauggccgcggagguuacccgcagaggcuccgcuuacuauauguaccuugaucggaacgacgccggggaagccauuucuuuccccacaacccugggaaugaauaaaugcuauauccagauuauggaucucggccacaugugugacgcuacaaugagcuacgagugcccuaugcuggaugaagggguggagccggacgauguggacuguuggugcaacaccacauccaccugggucguguauggaacgugucaucacaagaaaggcgaagcccgcagaucucggcgcgcuguuacccuucccagccauuccacaagaaagcugcaaacccggucucagacauggcucgagagccgcgaguacaccaaacaccugaucagaguggaaaauuggauuuuucggaacccuggcuucgcccuggcggccgcugccaucgcuuggcuccugggguccagcacgucucagaaggucaucuaucuugugaugauucugcucaucgcccccgcguacuccauucgcugcaucggaguuagcaauagagauuuuguggagggcaugucugggggaacaugggucgacauugugcuggaacauggcgggugugugaccgucauggcccaggauaagccuacaguugacaucgagcuugugaccaccacaguguccaacauggcugagguccggagcuacugcuaugaagccucuauuuccgauauggcuagcgacucccgcugucccacgcaaggagaggccuaccuggacaaacagucugauacccaguaugugugcaagagaacacucguugaccggggcuggggcaauggguguggacuguucggcaaagggagccuggugaccugcgccaaguuugcuugcuccaaaaagaugacaggaaagagcauccagccugaaaaccucgaguacagaaucaugcugucuguccacggcucccaacacagcgggaugauugugaaugauaccggacaugaaacggacgagaaccgcgcgaaaguugagaucacacccaauucuccccgggccgaagcuacccuuggcggcuucgggagccugggacucgauugugagccuagaaccggccuggacuuuuccgaucuuuauuaccugacaaugaacaauaagcacuggcucgugcauaaagaaugguuccacgacauuccccugccuuggcacgccggggccgauaccggaacaccccauuggaacaauaaggaggcucuggucgaauuuaaagacgcccacgcgaagcgccagacgguggucgugcucggcucucaggagggggcuguucauaccgcccuggccggcgcucuugaggccgaaauggauggagcuaaaggccggcugagcuccgggcaccucaagugcagacugaagauggacaaacuucgccugaagggagugagcuauucucucuguacagccgcguucaccuuuacaaaaaucccggccgagacccugcauggcacggucaccguggaaguucaguacgcugggacagacggaccuugcaaggugcccgcccaaauggcugucgauaugcagacccugacaccugugggccggcucauuaccgccaaccccgugaucacggaguccacagaaaacagcaaaaugaugcuggagcuugacccgccuuucggggauucuuacaucguuauuggcgucggagagaagaagaucacccaccacuggcauagauccggcagcacaauugggaaagcguuugaagccaccgugcgcggagcuaagcggauggccgugcugggcgacaccgcuugggauuucggguccgucggaggcgcccucaauucucuggggaaaggcauccaccagauuuucggagccgcuuuuaagagccuguucggcgggauguccugguuuucucaaauccuuaucggaacacuccugauguggcugggccucaacacgaaaaaugggagcauuucccugaugugucuugcgcugggaggcgugcucaucuuccugagcaccgccguuucugcugacugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8886 - RNA, 2308 nt, Artificial Sequence
  ZIKV prME variant mRNA Design 3 opt
gggagaaagcuuaccaugagacggggcgccgacaccagcguggggaucgucggacugcuccugacaacggcuauggccgcggagguuacccgcagaggcuccgcuuacuauauguaccuugaucggaacgacgccggggaagccauuucuuuccccacaacccugggaaugaauaagugcuauauccagauuauggaucucggccacaugugugacgcuacaaugagcuacgagugcccuaugcuggaugaagggguggagccggacgauguggacuguuggugcaacaccacauccaccugggucguguauggaacgugucaucacaaaaagggcgaagcccgcagaucucggcgcgcuguuacccuucccagccauuccacaagaaaacugcaaacccggucucagacauggcucgagagccgcgaguacaccaagcaccugaucagaguggaaaauuggauuuuucggaacccuggcuucgcccuggcggccgcugccaucgcuuggcuccugggguccagcacgucucagaaagucaucuaucuugugaugauucugcucaucgcccccgcguacuccauucgcugcaucggaguuagcaauagagauuuuguggagggcaugucugggggaacaugggucgacauugugcuggaacauggcgggugugugaccgucauggcccaggauaagccuacaguugacaucgagcuugugaccaccacaguguccaacauggcugagguccggagcuacugcuaugaagccucuauuuccgauauggcuagcgacucccgcugucccacgcaaggagaggccuaccuggacaagcagucugauacccaguaugugugcaaaagaacacucguugaccggggcuggggcaauggguguggacuguucggcaaggggagccuggugaccugcgccaaauuugcuugcuccaagaaaaugacaggaaagagcauccagccugaaaaccucgaguacagaaucaugcugucuguccacggcucccaacacagcgggaugauugugaaugauaccggacaugaaacggacgagaaccgcgcgaagguugagaucacacccaauucuccccgggccgaagcuacccuuggcggcuucgggagccugggacucgauugugagccuagaaccggccuggacuuuuccgaucuuuauuaccugacaaugaacaauaaacacuggcucgugcauaaggaaugguuccacgacauuccccugccuuggcacgccggggccgauaccggaacaccccauuggaacaauaaagaggcucuggucgaauuuaaggacgcccacgcgaaacgccagacgguggucgugcucggcucucaggagggggcuguucauaccgcccuggccggcgcucuugaggccgaaauggauggagcuaagggccggcugagcuccgggcaccucaaaugcagacugaagauggacaaacuucgccugaagggagugagcuauucucucuguacagccgcguucaccuuuacaaagaucccggccgagacccugcauggcacggucaccguggaaguucaguacgcugggacagacggaccuugcaaagugcccgcccaaauggcugucgauaugcagacccugacaccugugggccggcucauuaccgccaaccccgugaucacggaguccacagaaaacagcaagaugaugcuggagcuugacccgccuuucggggauucuuacaucguuauuggcgucggagagaaaaagaucacccaccacuggcauagauccggcagcacaauugggaaggcguuugaagccaccgugcgcggagcuaaacggauggccgugcugggcgacaccgcuugggauuucggguccgucggaggcgcccucaauucucuggggaagggcauccaccagauuuucggagccgcuuuuaaaagccuguucggcgggauguccugguuuucucaaauccuuaucggaacacuccugauguggcugggccucaacacgaagaaugggagcauuucccugaugugucuugcgcugggaggcgugcucaucuuccugagcaccgccguuucugcugacugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8887 - RNA, 2305 nt, Artificial Sequence
  ZIKV prME variant mRNA Design 3 opt
gggagaaagcuuaccaugagaggcgccgacaccagcguggggaucgucggacugcuccugacaacggcuauggccgcggagguuacccggcgcggcuccgcuuacuauauguaccuugauagaaacgacgccggggaagccauuucuuuccccacaacccugggaaugaauaagugcuauauccagauuauggaucucggccacaugugugacgcuacaaugagcuacgagugcccuaugcuggaugaagggguggagccggacgauguggacuguuggugcaacaccacauccaccugggucguguauggaacgugucaucacaaaaagggcgaagcccggcgcucuagacgggcuguuacccuucccagccauuccacacgcaaacugcaaaccagaucucagacauggcucgagagccgggaguacaccaagcaccugauccgcguggaaaauuggauuuuuagaaacccuggcuucgcccuggcggccgcugccaucgcuuggcuccugggguccagcacgucucagaaagucaucuaucuugugaugauucugcucaucgcccccgcguacuccauucggugcaucggaguuagcaaucgcgauuuuguggagggcaugucugggggaacaugggucgacauugugcuggaacauggcgggugugugaccgucauggcccaggauaagccuacaguugacaucgagcuugugaccaccacaguguccaacauggcugaggucagaagcuacugcuaugaagccucuauuuccgauauggcuagcgacucccggugucccacgcaaggagaggccuaccuggacaagcagucugauacccaguaugugugcaaacgcacacucguugacagaggcuggggcaauggguguggacuguucggcaaggggagccuggugaccugcgccaaauuugcuugcuccaagaaaaugacaggaaagagcauccagccugaaaaccucgaguaccggaucaugcugucuguccacggcucccaacacagcgggaugauugugaaugauaccggacaugaaacggacgagaacagagcgaagguugagaucacacccaauucuccccgcgccgaagcuacccuuggcggcuucgggagccugggacucgauugugagccucggaccggccuggacuuuuccgaucuuuauuaccugacaaugaacaauaaacacuggcucgugcauaaggaaugguuccacgacauuccccugccuuggcacgccggggccgauaccggaacaccccauuggaacaauaaagaggcucuggucgaauuuaaggacgcccacgcgaaaagacagacgguggucgugcucggcucucaggagggggcuguucauaccgcccuggccggcgcucuugaggccgaaauggauggagcuaagggccgccugagcuccgggcaccucaaaugccggcugaagauggacaaacuuagacugaagggagugagcuauucucucuguacagccgcguucaccuuuacaaagaucccggccgagacccugcauggcacggucaccguggaaguucaguacgcugggacagacggaccuugcaaagugcccgcccaaauggcugucgauaugcagacccugacaccugugggccgccucauuaccgccaaccccgugaucacggaguccacagaaaacagcaagaugaugcuggagcuugacccgccuuucggggauucuuacaucguuauuggcgucggagagaaaaagaucacccaccacuggcaucgguccggcagcacaauugggaaggcguuugaagccaccgugagaggagcuaaacgcauggccgugcugggcgacaccgcuugggauuucggguccgucggaggcgcccucaauucucuggggaagggcauccaccagauuuucggagccgcuuuuaaaagccuguucggcgggauguccugguuuucucaaauccuuaucggaacacuccugauguggcugggccucaacacgaagaaugggagcauuucccugaugugucuugcgcugggaggcgugcucaucuuccugagcaccgccguuucugcugacugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8888 - RNA, 2302 nt, Artificial Sequence
  ZIKV prME variant mRNA Design 3 opt
gggagaaagcuuaccaugggcgccgacaccagcguggggaucgucggacugcuccugacaacggcuauggccgcggagguuaccagacggggcuccgcuuacuauauguaccuugaucgcaacgacgccggggaagccauuucuuuccccacaacccugggaaugaauaagugcuauauccagauuauggaucucggccacaugugugacgcuacaaugagcuacgagugcccuaugcuggaugaagggguggagccggacgauguggacuguuggugcaacaccacauccaccugggucguguauggaacgugucaucacaaaaagggcgaagccagacggucucgcagagcuguuacccuucccagccauuccacacggaaacugcaaacccgcucucagacauggcucgagagcagagaguacaccaagcaccugauccggguggaaaauuggauuuuucgcaacccuggcuucgcccuggcggccgcugccaucgcuuggcuccugggguccagcacgucucagaaagucaucuaucuugugaugauucugcucaucgcccccgcguacuccauuagaugcaucggaguuagcaaucgggauuuuguggagggcaugucugggggaacaugggucgacauugugcuggaacauggcgggugugugaccgucauggcccaggauaagccuacaguugacaucgagcuugugaccaccacaguguccaacauggcugagguccgcagcuacugcuaugaagccucuauuuccgauauggcuagcgacuccagaugucccacgcaaggagaggccuaccuggacaagcagucugauacccaguaugugugcaaacggacacucguugaccgcggcuggggcaauggguguggacuguucggcaaggggagccuggugaccugcgccaaauuugcuugcuccaagaaaaugacaggaaagagcauccagccugaaaaccucgaguacagaaucaugcugucuguccacggcucccaacacagcgggaugauugugaaugauaccggacaugaaacggacgagaaccgggcgaagguugagaucacacccaauucucccagagccgaagcuacccuuggcggcuucgggagccugggacucgauugugagccucgcaccggccuggacuuuuccgaucuuuauuaccugacaaugaacaauaaacacuggcucgugcauaaggaaugguuccacgacauuccccugccuuggcacgccggggccgauaccggaacaccccauuggaacaauaaagaggcucuggucgaauuuaaggacgcccacgcgaaacggcagacgguggucgugcucggcucucaggagggggcuguucauaccgcccuggccggcgcucuugaggccgaaauggauggagcuaagggcagacugagcuccgggcaccucaaaugccgccugaagauggacaaacuucggcugaagggagugagcuauucucucuguacagccgcguucaccuuuacaaagaucccggccgagacccugcauggcacggucaccguggaaguucaguacgcugggacagacggaccuugcaaagugcccgcccaaauggcugucgauaugcagacccugacaccugugggcagacucauuaccgccaaccccgugaucacggaguccacagaaaacagcaagaugaugcuggagcuugacccgccuuucggggauucuuacaucguuauuggcgucggagagaaaaagaucacccaccacuggcaucgcuccggcagcacaauugggaaggcguuugaagccaccgugcggggagcuaaaagaauggccgugcugggcgacaccgcuugggauuucggguccgucggaggcgcccucaauucucuggggaagggcauccaccagauuuucggagccgcuuuuaaaagccuguucggcgggauguccugguuuucucaaauccuuaucggaacacuccugauguggcugggccucaacacgaagaaugggagcauuucccugaugugucuugcgcugggaggcgugcucaucuuccugagcaccgccguuucugcugacugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8889 - RNA, 2299 nt, Artificial Sequence
  ZIKV prME variant mRNA Design 3 opt
gggagaaagcuuaccauggccgacaccagcgugggcaucgucgggcugcuccugacaacggcuauggccgcggagguuaccagacggggauccgcuuacuauauguaccuugaucgcaacgacgccggcgaagccauuucuuuccccacaacccuggggaugaauaagugcuauauccagauuauggaucucggacacaugugugacgcuacaaugagcuacgagugcccuaugcuggaugaaggcguggagccggacgauguggacuguuggugcaacaccacauccaccugggucguguaugggacgugucaucacaaaaagggagaagccagacggucucgcagagcuguuacccuucccagccauuccacacggaaacugcaaacccgcucucagacauggcucgagagcagagaguacaccaagcaccugauccggguggaaaauuggauuuuucgcaacccuggcuucgcccuggcggccgcugccaucgcuuggcuccugggcuccagcacgucucagaaagucaucuaucuugugaugauucugcucaucgcccccgcguacuccauuagaugcaucgggguuagcaaucgggauuuuguggagggaaugucuggcgggacaugggucgacauugugcuggaacauggaggcugugugaccgucauggcccaggauaagccuacaguugacaucgagcuugugaccaccacaguguccaacauggcugagguccgcagcuacugcuaugaagccucuauuuccgauauggcuagcgacuccagaugucccacgcaaggggaggccuaccuggacaagcagucugauacccaguaugugugcaaacggacacucguugaccgcggauggggcaauggcugugggcuguucggaaagggcagccuggugaccugcgccaaauuugcuugcuccaagaaaaugacaggaaagagcauccagccugaaaaccucgaguacagaaucaugcugucuguccacgggucccaacacagcggcaugauugugaaugauaccgggcaugaaacggacgagaaccgggcgaagguugagaucacacccaauucucccagagccgaagcuacccuuggaggcuucggcagccuggggcucgauugugagccucgcaccggacuggacuuuuccgaucuuuauuaccugacaaugaacaauaaacacuggcucgugcauaaggaaugguuccacgacauuccccugccuuggcacgccggcgccgauaccgggacaccccauuggaacaauaaagaggcucuggucgaauuuaaggacgcccacgcgaaacggcagacgguggucgugcucggaucucaggagggcgcuguucauaccgcccuggccggggcucuugaggccgaaauggauggcgcuaagggaagacugagcuccggccaccucaaaugccgccugaagauggacaagcugcggcugaaaggggugagcuauucucucuguacagccgcguucaccuuuacaaagaucccggccgagacccugcauggaacggucaccguggaaguucaguacgcuggcacagacgggccuugcaaagugcccgcccaaauggcugucgauaugcagacccugacaccugugggaagacucauuaccgccaaccccgugaucacggaguccacagaaaacagcaagaugaugcuggagcuugacccgccuuucggcgauucuuacaucguuauuggggucggcgagaaaaagaucacccaccacuggcaucgcuccggaagcacaauuggcaaggcguuugaagccaccgugagaggggcuaaacggauggccgugcugggagacaccgcuugggauuucggcuccgucgggggagcccucaauucucugggcaaggggauccaccagauuuucggcgccgcuuuuaaaagccuguucggaggcauguccugguuuucucaaauccuuaucgggacacuccugauguggcugggacucaacacgaagaauggcagcauuucccugaugugucuugcgcuugggggagugcucaucuuccugagcaccgccguuucugcugacugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8890 - RNA, 2296 nt, Artificial Sequence
  ZIKV prME variant mRNA Design 3 opt
gggagaaagcuuaccauggacaccagcgugggcaucgucgggcugcuccugacaacggccauggcugccgagguuaccagacggggauccgcguacuauauguaccuugaucgcaacgacgcuggcgaagccauuucuuuccccacaacccuggggaugaauaagugcuauauccagauuauggaucucggacacaugugugacgccacaaugagcuacgagugcccuaugcuggaugaaggcguggagccggacgauguggacuguuggugcaacaccacauccaccugggucguguaugggacgugucaucacaaaaagggagaagcuagacggucucgcagagccguuacccuucccagccauuccacacggaaacugcaaacccgcucucagacauggcucgagagcagagaguacaccaagcaccugauccggguggaaaauuggauuuuucgcaacccuggcuucgcucuggccgcggccgcuaucgccuggcuccugggcuccagcacgucucagaaagucaucuaucuugugaugauucugcucaucgcucccgccuacuccauuagaugcaucgggguuagcaaucgggauuuuguggagggaaugucuggcgggacaugggucgacauugugcuggaacauggaggcugugugaccgucauggcgcaggauaagccuacaguugacaucgagcuugugaccaccacaguguccaacauggccgagguccgcagcuacugcuaugaagcuagcauuuccgauauggccagcgacuccagaugucccacgcaaggggaggcuuaccuggacaagcagucugauacccaguaugugugcaaacggacacucguugaccgcggauggggcaauggcugugggcuguucggaaagggcagccuggugaccugcgccaaauuugccugcuccaagaaaaugacagggaagucuauccagccugaaaaccucgaguacagaaucaugcugucuguccacggaucccaacacagcggcaugauugugaaugauaccgggcaugaaacggacgagaaccgggcuaagguugagaucacacccaauucucccagagcggaagccacccuuggaggcuucggcagccuggggcucgauugugagccucgcaccggacuggacuuuuccgaucuuuauuaccugacaaugaacaauaaacacuggcucgugcauaaggaaugguuccacgacauuccccugccuuggcacgcuggcgccgauaccgggacaccccauuggaacaauaaagaggcccuggucgaauuuaaggacgcucacgccaaacggcagacgguggucgugcucggaucucaggagggcgcgguucauaccgcucuggccggggcccuugaggcugaaauggauggcgccaagggaagacugagcuccggccaccucaaaugccgccugaagauggacaagcugcggcugaaaggggugagcuauucucucuguacagcugccuucaccuuuacaaagaucccggcggagacccugcauggaacggucaccguggaaguucaguacgccggcacagacgggccuugcaaagugcccgcucaaauggccgucgauaugcagacccugacaccugugggaagacucauuaccgcuaaccccgugaucacggaguccacagaaaacagcaagaugaugcuggagcuugacccgccuuucggcgauucuuacaucguuauuggggucggcgagaaaaagaucacccaccacuggcaucgcuccggaagcacaauuggcaaggccuuugaagcgaccgugagaggggccaaacggauggcugugcugggagacaccgccugggauuucggcuccgucgggggagcucucaauucucugggcaaggggauccaccagauuuucggcgccgccuuuaaaagccuguucggaggcauguccugguuuucucaaauccuuaucgggacacuccugauguggcugggacucaacacgaagaauggcagcauuucccugaugugucuugcucuugggggagugcucaucuuccugagcaccgcgguuucugccgacugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8891 - RNA, 2293 nt, Artificial Sequence
  ZIKV prME variant mRNA Design 3 opt
gggagaaagcuuaccaugaccagcgugggcaucgucgggcugcuccugacaacggccauggcugccgagguuaccagacggggauccgcguacuauauguaccuugaccgcaacgaugcuggcgaagccauuucuuuccccacaacccuggggaugaauaagugcuauauccagauuauggaccucggacacaugugugaugccacaaugagcuacgagugcccuaugcuggacgaaggcguggagccggaugacguggauuguuggugcaacaccacauccaccugggucguguaugggacgugucaucacaaaaagggagaagcuagacggucucgcagagccguuacccuucccagccauuccacacggaaacugcaaacccgcucucagacauggcucgagagcagagaguacaccaagcaccugauccggguggaaaauuggauuuuucgcaacccuggcuucgcucuggccgcggccgcuaucgccuggcuccugggcuccagcacgucucagaaagucaucuaucuugugaugauucugcucaucgcucccgccuacuccauuagaugcaucgggguuagcaaucgggacuuuguggagggaaugucuggcgggacaugggucgauauugugcuggaacauggaggcugugugaccgucauggcgcaggacaagccuacaguugauaucgagcuugugaccaccacaguguccaacauggccgagguccgcagcuacugcuaugaagcuagcauuuccgacauggccagcgauuccagaugucccacgcaaggggaggcuuaccuggacaagcagucugacacccaguaugugugcaaacggacacucguugaucgcggauggggcaauggcugugggcuguucggaaagggcagccuggugaccugcgccaaauuugccugcuccaagaaaaugacagggaagucuauccagccugaaaaccucgaguacagaaucaugcugucuguccacggaucccaacacagcggcaugauugugaaugacaccgggcaugaaacggaugagaaccgggcuaagguugagaucacacccaauucuccgagagcggaagccacccuuggaggcuucggcagccuggggcucgacugugagccucgcaccggacuggauuuuuccgaccuuuauuaccugacaaugaacaauaaacacuggcucgugcauaaggaaugguuccacgauauuccccugccuuggcacgcuggcgccgacaccgggacaccccauuggaacaauaaagaggcccuggucgaauuuaaggaugcucacgccaaacggcagacgguggucgugcucggaucucaggagggcgcgguucauaccgcucuggccggggcccuugaggcugaaauggacggcgccaagggaagacugagcuccggccaccucaaaugccgccugaagauggauaagcugcggcugaaaggggugagcuauucucucuguacagcugccuucaccuuuacaaagaucccggcggagacccugcauggaacggucaccguggaaguucaguacgccggcacagacgggccuugcaaagugcccgcucaaauggccgucgacaugcagacccugacaccugugggaagacucauuaccgcuaaccccgugaucacggaguccacagaaaacagcaagaugaugcuggagcuugaucccccuuucggcgacucuuacaucguuauuggggucggcgagaaaaagaucacccaccacuggcaucgcuccggaagcacaauuggcaaggccuuugaagcgaccgugagaggggccaaacggauggcugugcugggagauaccgccugggacuucggcuccgucgggggagcucucaauucucugggcaaggggauccaccagauuuucggcgccgccuuuaaaagccuguucggaggcauguccugguuuucucaaauccuuaucgggacacuccugauguggcugggacucaacacgaagaauggcagcauuucccugaugugucuugcucuugggggagugcucaucuuccugagcaccgcgguuucugccgauugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8892 - RNA, 2293 nt, Artificial Sequence
  ZIKV prME variant mRNA Design 3 opt
gggagaaagcuuaccaugaccagcgugggcaucgucgggcugcuccugacaacggccauggcugccgcgguuaccagacggggauccgcuuacuauauguaccuugaccgcaacgaugccggcgaggccauuucuuuccccacaacccuggggaugaauaagugcuauauccagauuauggaccucggacacaugugugaugcuacaaugagcuacgaaugcccuaugcuggacgagggcguggaaccggaugacguggauuguuggugcaacaccacauccaccugggucguguaugggacgugucaucacaaaaagggagaggccagacggucucgcagagcuguuacccuucccagccauuccacacggaaacugcaaacccgcucucagacauggcucgaaagcagagaguacaccaagcaccugauccggguggagaauuggauuuuucgcaacccuggcuucgcccuggcggccgcugccaucgcuuggcuccugggcuccagcacgucucagaaagucaucuaucuugugaugauucugcucaucgcccccgcguacuccauuagaugcaucgggguuagcaaucgggacuuuguggaaggaaugucuggcgggacaugggucgauauugugcuggagcauggaggcugugugaccgucauggcccaggacaagccuacaguugauaucgaacuugugaccaccacaguguccaacauggcugagguccgcagcuacugcuaugaggccucuauuuccgacauggcuagcgauuccagaugucccacgcaaggggaagccuaccuggacaagcagucugacacccaguaugugugcaaacggacacucguugaucgcggauggggcaauggcugugggcuguucggaaagggcagccuggugaccugcgccaaauuugcuugcuccaagaaaaugacagggaagucuauccagccugagaaccucgaauacagaaucaugcugucuguccacggaucccaacacagcggcaugauugugaaugacaccgggcaugagacggaugaaaaccgggcgaagguugagaucacaccgaauagccccagagccgaggcuacccuuggaggcuucggcagccuggggcucgacugugaaccucgcaccggacuggauuuuuccgaccuuuauuaccugacaaugaacaauaaacacuggcucgugcauaaggagugguuccacgauauuccccugccuuggcacgccggcgccgacaccgggacaccccauuggaacaauaaagaagcucuggucgaguuuaaggaugcccacgcgaaacggcagacgguggucgugcucggaucucaggaaggcgcuguucauaccgcccuggccggggcucuugaggccgagauggacggcgcuaagggaagacugagcuccggccaccucaaaugccgccugaagauggauaagcugcggcugaaaggggugagcuauucucucuguacagccgcguucaccuuuacaaagaucccggccgaaacccugcauggaacggucaccguggagguucaguacgcuggcacagacgggccuugcaaagugcccgcccaaauggcugucgacaugcagacccugacaccugugggaagacucauuaccgccaaccccgugaucacggaauccacagagaacagcaagaugaugcuggaacuugaucccccuuucggcgacucuuacaucguuauuggggucggcgagaaaaagaucacccaccacuggcaucgcuccggaagcacaauuggcaaggcguuugaggccaccgugagaggggcuaaacggauggccgugcugggagauaccgcuugggacuucggcuccgucgggggagcccucaauucucugggcaaggggauccaccagauuuucggcgccgcuuuuaaaagccuguucggaggcauguccugguuuucucaaauccuuaucgggacacuccugauguggcugggacucaacacgaagaauggcagcauuucccugaugugucuugcgcuugggggagugcucaucuuccugagcaccgccguuucugcugauugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8893 - RNA, 2305 nt, Artificial Sequence
  ZIKV prME variant mRNA Design 3 opt
gggagaaagcuuaccaugagaggcgccgacaccagcguggggaucgucggacugcuccugacaacggcuauggccgcggcuguuacccggcgcggcuccgccuacuauauguaccuugauagaaacgacgccggggaggcuauuucuuuccccacaacccugggaaugaauaagugcuauauccagauuauggaucucggccacaugugugacgccacaaugagcuacgaaugcccuaugcuggaugaggggguggaaccggacgauguggacuguuggugcaacaccacauccaccugggucguguauggaacgugucaucacaaaaagggcgaggcucggcgcucuagacgggccguuacccuucccagccauuccacacgcaaacugcaaaccagaucucagacauggcucgaaagccgggaguacaccaagcaccugauccgcguggagaauuggauuuuuagaaacccuggcuucgcgcuggccgcugccgcuaucgccuggcuccugggguccagcacgucucagaaagucaucuaucuugugaugauucugcucaucgcgcccgccuacuccauucggugcaucggaguuagcaaucgcgauuuuguggaaggcaugucugggggaacaugggucgacauugugcuggagcauggcgggugugugaccgucauggcucaggauaagccuacaguugacaucgaacuugugaccaccacaguguccaacauggccgaggucagaagcuacugcuaugaggcuucuauuuccgauauggccagcgacucccggugucccacgcaaggagaagccuaccuggacaagcagucugauacccaguaugugugcaaacgcacacucguugacagaggcuggggcaauggguguggacuguucggcaaggggagccuggugaccugcgcuaaauuugcgugcuccaagaaaaugacaggaaagagcauccagccugagaaccucgaauaccggaucaugcugucuguccacggcucccaacacagcgggaugauugugaaugauaccggacaugagacggacgaaaacagagccaagguugagaucacacccaauucuccccgcgcugaggccacccuuggcggcuucgggagccugggacucgauugugaaccucggaccggccuggacuuuuccgaucuuuauuaccugacaaugaacaauaaacacuggcucgugcauaaggagugguuccacgacauuccccugccuuggcacgccggggcugauaccggaacaccccauuggaacaauaaagaagcccuggucgaguuuaaggacgcgcacgcuaaaagacagacgguggucgugcucggcucucaggaaggggccguucauaccgcccuggcuggcgcccuugaggcugagauggauggagccaagggccgccugagcuccgggcaccucaaaugccggcugaagauggacaaacuuagacugaagggagugagcuauucucucuguacagcggccuucaccuuuacaaagaucccggcugaaacccugcauggcacggucaccguggagguucaguacgccgggacagacggaccuugcaaagugcccgcucaaauggccgucgauaugcagacccugacaccugugggccgccucauuaccgcgaaccccgugaucacggaauccacagagaacagcaagaugaugcuggaacuugacccgccuuucggggauucuuacaucguuauuggcgucggagagaaaaagaucacccaccacuggcaucgguccggcagcacaauugggaaggccuuugaggcuaccgugagaggagccaaacgcauggcugugcugggcgacaccgccugggauuucggguccgucggaggcgcccucaauucucuggggaagggcauccaccagauuuucggagcugcguuuaaaagccuguucggcgggauguccugguuuucucaaauccuuaucggaacacuccugauguggcugggccucaacacgaagaaugggagcauuucccugaugugucuugcccugggaggcgugcucaucuuccugagcaccgcuguuucugccgacugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8894 - RNA, 2329 nt, Artificial Sequence
  ZIKV prME variant mRNA Design 3 opt
gggagaaagcuuaccaugagaggccugagcucccggaagcgcagaucucacgacgugcucaccguccaguuccugauccuugggaugcugcucaugacaggaggcguuacgcggcgcgggagcgccuacuauauguaccuggauagaaacgacgcuggagaggccauuuccuuucccaccacacuuggcaugaauaaaugcuauauccaaauuauggaucuggggcauaugugugacgcgaccaugucuuacgaaugcccuaugcucgaugagggaguggaaccggacgauguggacuguuggugcaacacaaccagcacaugggucguguauggcaccugucaccauaagaaaggcgaggcucggcgcuccagacgggccguuacgcugcccucucacagcacccgcaagcugcagacaagaucccagaccuggcucgaaagccgggaguacacaaaacaucugauccgcguggagaauuggauuuucagaaacccuggguuugcccuugcugccgcugccaucgcguggcugcucggaucuuccaccagccagaaggucaucuaucuggugaugauucuucugaucgcccccgcuuacucuauucggugcaucggcguuuccaaucgcgauuucguggaagggaugagcggaggcacgugggucgacauugugcucgagcacgggggaugugugacagucauggcccaagauaagccuaccguugacaucgaacuggugacaaccaccgugucuaacauggcugaggucagauccuacugcuaugaggccagcauuuccgauauggcgucugacagccggugucccacacagggcgaagccuaccuggacaaacaguccgauacgcaguaugugugcaagagaacccucguugaccgcggcugggggaauggauguggccuguuugggaaaggaagccuugugacaugcgcuaaguucgccugcucuaaaaagaugaccggcaaguccauccaaccugagaaccuggaauaccggaucaugcucagcguccacgggucucagcauagcggaaugauugugaaugauacaggccacgagaccgacgaaaacagagcuaaaguugagaucacgcccaauuccccgcgcgccgaggccacacugggcggguuuggaucucuuggccuggauugugaaccucggaccgggcucgacuucagcgaucuguauuaccugaccaugaacaauaagcauuggcucgugcacaaagagugguuucacgacauuccccugccuuggcaugcuggagcggauacaggcacaccccacuggaacaauaaggaagcccuugucgaguucaaagacgcucaugccaagagacagacaguggucgugcuggggucccaggaaggcgccguucacacggcucucgccggagcgcuggaggcugagauggauggcgccaaagggcgccuuagcucuggacaucugaagugccggcucaagauggacaaacugagacugaagggcguguccuauagccucuguaccgccgcuuuuacauucaccaaaaucccggccgaaacacugcacgggaccgucacgguggagguucaauacgcuggaaccgacggcccuugcaaggugcccgcccagauggcggucgauaugcagacacuuaccccuguggggcgccugauuacagccaaccccgugaucaccgaaucuacggagaacuccaaaaugaugcucgaacuggaucccccuuuuggcgacagcuacaucguuauuggagucggcgagaagaagaucacacaccauuggcaccgguccgggucuaccauuggaaaggcuuucgaggccacagugagaggcgcuaaacgcauggccgugcugggggacaccgcgugggauuucggaagcgucggcggggcccuuaauucccucggcaaaggaauccaucaaauuuuuggcgcugccuucaagucucuguuugggggaaugagcugguucucccagauccugaucggcacccuccugauguggcuugggcugaacaccaaaaauggaagcauuucucucaugugucuggcucugggcggggugcuuaucuuucucuccacggccguuagcgccgacugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8895 - RNA, 2329 nt, Artificial Sequence
  ZIKV prME variant mRNA Design 3 opt
gggagaaagcuuaccaugagaggccugagcucccggaagcgcagaucucacgacgugcucaccguccaguuccugauccuugggaugcugcucaugacaggagccguuacgcggcgcggcagcgcuuacuauauguaccuggauagaaacgacgccggggaggcgauuuccuuucccaccacacuuggaaugaauaaaugcuauauccaaauuauggaucugggccauaugugugacgcuaccaugucuuacgaaugcccuaugcucgaugaggggguggaaccggacgauguggacuguuggugcaacacaaccagcacaugggucguguauggaaccugucaccauaagaaaggcgaggcccggcgcuccagacgggccguuacgcugcccucucacagcacccgcaagcugcagacaagaucccagaccuggcucgaaagccgggaguacacaaaacaucugauccgcguggagaauuggauuuucagaaacccuggcuuugcucuugccgcugccgcgaucgccuggcugcucgggucuuccaccagccagaaggucaucuaucuggugaugauucuucugaucgcucccgccuacucuauucggugcaucggaguuuccaaucgcgauuucguggaaggcaugagcgggggaacgugggucgacauugugcucgagcacggcgggugugugacagucauggcucaagauaagccuaccguugacaucgaacuggugacaaccaccgugucuaacauggccgaggucagauccuacugcuaugaggcgagcauuuccgauauggccucugacagccggugucccacacagggagaggcuuaccuggacaaacaguccgauacgcaguaugugugcaagagaacccucguugaccgcggcuggggcaauggguguggacuguuuggcaaagggagccuugugacaugcgccaaguucgcuugcucuaaaaagaugaccggaaaguccauccaaccugaaaaccuggaauaccggaucaugcucagcguccacggcucucagcauagcgggaugauugugaaugauacaggacacgagaccgacgaaaacagagccaaaguugagaucacgcccaauuccccgcgcgccgaggcuacacugggcggcuuugggucucuuggacuggauugugaaccucggaccggccucgacuucagcgaucuguauuaccugaccaugaacaauaagcauuggcucgugcacaaagagugguuucacgacauuccccugccuuggcaugcgggggccgauacaggaacaccccacuggaacaauaaggaagcucuugucgaguucaaagacgcccaugccaagagacagacaguggucgugcugggcucccaggaaggggcuguucacacggcccucgcgggcgcucuggaggccgagauggauggagccaaaggccgccuuagcucugggcaucugaagugccggcucaagauggacaaacugagacugaagggaguguccuauagccucuguaccgcugccuuuacauucaccaaaaucccggcugaaacacugcacggcaccgucacgguggagguucaauacgccgggaccgacggaccuugcaaggugcccgcgcagauggccgucgauaugcagacacuuaccccugugggccgccugauuacagcuaaccccgugaucaccgaaucuacggagaacuccaaaaugaugcucgaacuggaucccccuuuuggggacagcuacaucguuauuggcgucggagagaagaagaucacacaccauuggcaccgguccggcucuaccauugggaaagccuucgaggcuacagugagaggagccaagcgcauggcggugcugggcgacaccgccugggauuucgggagcgucggaggcgcucuuaauucccucgggaaaggcauccaucaaauuuuuggagccgcuuucaagucucuguuuggcgggaugagcugguucucccagauccugaucggaacccuccugauguggcuuggccugaacaccaaaaaugggagcauuucucucaugugucuggcccugggaggcgugcuuaucuuucucuccacggccguuagcgcugacugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8896 - RNA, 2335 nt, Artificial Sequence
  ZIKV prME variant mRNA Design 3 opt
gggagaaagcuuaccaugagaaucauuaacgcccggaaggagaaaaagcgcagaggcgcugacaccagcguggggaucgucggacugcuccugacaacggccauggcggcugaaguuacccggcgcggcuccgccuacuauauguaccuugauagaaaugacgccggggaggcuauuucuuuccccacaacccugggaaugaacaaaugcuauauccagauuauggaucucggccacaugugugacgccacaaugagcuacgaaugcccuaugcuggaugaggggguggaaccggacgauguggacuguuggugcaauaccacauccaccugggucguguauggaacgugucaucacaagaaaggcgaggcucggcgcucuagacgggccguuacccuucccagccauuccacacgcaagcugcaaaccagaucucagacauggcucgagagccgggaauacaccaagcaccugauccgcguggagaacuggaucuuuagaaauccuggcuucgcgcuggccgcugccgcuauugccuggcuccugggguccagcacgucucagaaagucaucuaucuugugaugauucugcucaucgcgcccgccuacuccauucggugcaucggaguuagcaaccgcgauuuuguggaaggcaugucugggggaacaugggucgacauugugcuggagcauggcgggugugugaccgucauggcucaggauaagccuacaguugacaucgagcuugugaccaccacaguguccaauauggccgaagucagaagcuacugcuaugaggcuucuaucuccgauauggccagcgacucccggugucccacgcaaggagaagccuaccuggacaaacagucugauacccaguaugugugcaagagaacacucguugaccgcggcuggggcaacggguguggacuguucggcaaagggagccuggugaccugcgcuaaguuugcgugcuccaagaaaaugacaggaaagagcauucagccugagaaucucgaauaccggaucaugcugucuguccacggcucccaacacagcgggaugauugugaacgauaccggacaugagacggacgagaauagagccaaaguugaaaucacaccgaacucuccccgcgcugaggccacccuuggcggcuucgggagccugggacucgauugugaaccucggaccggccuggacuuuuccgaucuuuauuaccugacaaugaauaacaagcacuggcucgugcauaaagagugguuccacgacauuccccugccuuggcacgccggggcugauaccggaacaccccauuggaauaacaaggaagcccuggucgaguuuaaagacgcgcacgcuaagagacagacgguggucgugcucggcucucaggagggggccguucauaccgcccuggcuggcgcccuugaagcugagauggauggagccaagggccgccugagcuccgggcaccucaaaugccggcugaagauggacaaacuuagacugaagggagugagcuauucucucuguacagcggccuucaccuuuacaaaaaucccggcugaaacccugcauggcacggucaccguggagguucaguacgccgggacagacggaccuugcaaggugcccgcucaaauggccgucgauaugcagacccugacaccugugggccgccucaucaccgcgaaccccgugauuacggaauccacagagaauagcaagaugaugcuggagcuugaucccccuuucggggacucuuacaucguuauuggcgucggagagaaaaagaucacccaccacuggcaucgguccggcagcacaauugggaaagccuuugaagcuaccgugagaggagccaagcgcauggcugugcugggcgacaccgccugggauuucggguccgucggaggcgcccucaacucucuggggaaaggcauccaccagaucuucggagcugcguuuaagagccuguucggcgggauguccugguuuucucaaauucuuaucggaacacuccugauguggcugggccucaauacgaagaacgggagcauuucccugaugugucuugcccugggaggcgugcucaucuuccugagcaccgcuguuucugccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8897 - RNA, 2329 nt, Artificial Sequence
  ZIKV prME variant mRNA Design 3 opt
gggagaaagcuuaccaugaucaacgccagaaaggagaaaaagcggcgcggcgcugacaccagcguggggauugucggacugcuccugacaacggccauggcggcugaaguuaccagacggggcuccgccuacuauauguaccuugaucgcaaugacgccggggaggcuaucucuuuccccacaacccugggaaugaacaaaugcuauauucagaucauggaucucggccacaugugugacgccacaaugagcuacgaaugcccuaugcuggaugaggggguggaaccggacgauguggacuguuggugcaauaccacauccaccugggucguguauggaacgugucaucacaagaaaggcgaggcuagacggucucgcagagccguuacccuucccagccauuccacacggaagcugcaaacccgcucucagacauggcucgagagcagagaauacaccaagcaccugauucggguggagaacuggaucuuucgcaauccuggcuucgcgcuggccgcugccgcuaucgccuggcuccugggguccagcacgucucagaaagucauuuaucuugugaugauccugcucauugcgcccgccuacuccaucagaugcauuggaguuagcaaccgggauuuuguggaaggcaugucugggggaacaugggucgacaucgugcuggagcauggcgggugugugaccgucauggcucaggauaagccuacaguugacauugagcuugugaccaccacaguguccaauauggccgaaguccgcagcuacugcuaugaggcuucuaucuccgauauggccagcgacuccagaugucccacgcaaggagaagccuaccuggacaaacagucugauacccaguaugugugcaagcggacacucguugacagaggcuggggcaacggguguggacuguucggcaaagggagccuggugaccugcgcuaaguuugcgugcuccaagaaaaugacaggaaagagcauccagccugagaaucucgaauaccgcauuaugcugucuguccacggcucccaacacagcgggaugaucgugaacgauaccggacaugagacggacgagaaucgggccaaaguugaaauuacaccgaacucucccagagcugaggccacccuuggcggcuucgggagccugggacucgauugugaaccucgcaccggccuggacuuuuccgaucuuuauuaccugacaaugaauaacaagcacuggcucgugcauaaagagugguuccacgacaucccccugccuuggcacgccggggcugauaccggaacaccccauuggaauaacaaggaagcccuggucgaguuuaaagacgcgcacgcuaagcggcagacgguggucgugcucggcucucaggagggggccguucauaccgcccuggcuggcgcccuugaagcugagauggauggagccaagggcagacugagcuccgggcaccucaaaugccgccugaagauggacaaacuucggcugaagggagugagcuauucucucuguacagcggccuucaccuuuacaaaaauuccggcugaaacccugcauggcacggucaccguggagguucaguacgccgggacagacggaccuugcaaggugcccgcucaaauggccgucgauaugcagacccugacaccugugggcagacucaucaccgcgaaccccgugaucacggaauccacagagaauagcaagaugaugcuggagcuugaucccccuuucggggacucuuacauuguuaucggcgucggagagaaaaagauuacccaccacuggcaucgcuccggcagcacaaucgggaaagccuuugaagcuaccgugcggggagccaagagaauggcugugcugggcgacaccgccugggauuucggguccgucggaggcgcccucaacucucuggggaaaggcauucaccagaucuucggagcugcguuuaagagccuguucggcgggauguccugguuuucucaaauccuuauuggaacacuccugauguggcugggccucaauacgaagaacgggagcaucucccugaugugucuugcccugggaggcgugcucauuuuccugagcaccgcuguuucugccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8898 - RNA, 2332 nt, Artificial Sequence
  ZIKV prME variant mRNA Design 3 opt
gggagaaagcuuaccaugaucauuaacgccagaaaggagaaaaagcggcgcggcgcugacaccagcguggggaucgucggacugcuccugacaacggccauggcggcugaaguuaccagacggggcuccgccuacuauauguaccuugaucgcaaugacgccggggaggcuauuucuuuccccacaacccugggaaugaacaaaugcuauauccagauuauggaucucggccacaugugugacgccacaaugagcuacgaaugcccuaugcuggaugaggggguggaaccggacgauguggacuguuggugcaauaccacauccaccugggucguguauggaacgugucaucacaagaaaggcgaggcuagacggucucgcagagccguuacccuucccagccauuccacacggaagcugcaaacccgcucucagacauggcucgagagcagagaauacaccaagcaccugauccggguggagaacuggaucuuucgcaauccuggcuucgcgcuggccgcugccgcuauugccuggcuccugggguccagcacgucucagaaagucaucuaucuugugaugauucugcucaucgcgcccgccuacuccauuagaugcaucggaguuagcaaccgggauuuuguggaaggcaugucugggggaacaugggucgacauugugcuggagcauggcgggugugugaccgucauggcucaggauaagccuacaguugacaucgagcuugugaccaccacaguguccaauauggccgaaguccgcagcuacugcuaugaggcuucuaucuccgauauggccagcgacuccagaugucccacgcaaggagaagccuaccuggacaaacagucugauacccaguaugugugcaagcggacacucguugacagaggcuggggcaacggguguggacuguucggcaaagggagccuggugaccugcgcuaaguuugcgugcuccaagaaaaugacaggaaagagcauucagccugagaaucucgaauaccgcaucaugcugucuguccacggcucccaacacagcgggaugauugugaacgauaccggacaugagacggacgagaaucgggccaaaguugaaaucacaccgaacucucccagagcugaggccacccuuggcggcuucgggagccugggacucgauugugaaccucgcaccggccuggacuuuuccgaucuuuauuaccugacaaugaauaacaagcacuggcucgugcauaaagagugguuccacgacauuccccugccuuggcacgccggggcugauaccggaacaccccauuggaauaacaaggaagcccuggucgaguuuaaagacgcgcacgcuaagcggcagacgguggucgugcucggcucucaggagggggccguucauaccgcccuggcuggcgcccuugaagcugagauggauggagccaagggcagacugagcuccgggcaccucaaaugccgccugaagauggacaaacuucggcugaagggagugagcuauucucucuguacagcggccuucaccuuuacaaaaaucccggcugaaacccugcauggcacggucaccguggagguucaguacgccgggacagacggaccuugcaaggugcccgcucaaauggccgucgauaugcagacccugacaccugugggcagacucaucaccgcgaaccccgugauuacggaauccacagagaauagcaagaugaugcuggagcuugaucccccuuucggggacucuuacaucguuauuggcgucggagagaaaaagaucacccaccacuggcaucgcuccggcagcacaauugggaaagccuuugaagcuaccgugcggggagccaagagaauggcugugcugggcgacaccgccugggauuucggguccgucggaggcgcccucaacucucuggggaaaggcauccaccagaucuucggagcugcguuuaagagccuguucggcgggauguccugguuuucucaaauucuuaucggaacacuccugauguggcugggccucaauacgaagaacgggagcauuucccugaugugucuugcccugggaggcgugcucaucuuccugagcaccgcuguuucugccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8899 - RNA, 2326 nt, Artificial Sequence
  ZIKV prME variant mRNA Design 3 opt
gggagaaagcuuaccaugaacgccagaaaggagaaaaagcggcgcggcgcugacaccagcguggggaucgucggacugcuccugacaacggccauggcggcugaaguuaccagacggggcuccgccuacuauauguaccuugaucgcaaugacgccggggaggcuauuucuuuccccacaacccugggaaugaacaaaugcuauauccagauuauggaucucggccacaugugugacgccacaaugagcuacgaaugcccuaugcuggaugaggggguggaaccggacgauguggacuguuggugcaauaccacauccaccugggucguguauggaacgugucaucacaagaaaggcgaggcuagacggucucgcagagccguuacccuucccagccauuccacacggaagcugcaaacccgcucucagacauggcucgagagcagagaauacaccaagcaccugauccggguggagaacuggauuuuucgcaauccuggcuucgcgcuggccgcugccgcuaucgccuggcuccugggguccagcacgucucagaaagucaucuaucuugugaugauucugcucaucgcgcccgccuacuccauuagaugcaucggaguuagcaaccgggauuuuguggaaggcaugucugggggaacaugggucgacauugugcuggagcauggcgggugugugaccgucauggcucaggauaagccuacaguugacaucgagcuugugaccaccacaguguccaauauggccgaaguccgcagcuacugcuaugaggcuucuauuuccgauauggccagcgacuccagaugucccacgcaaggagaagccuaccuggacaaacagucugauacccaguaugugugcaagcggacacucguugacagaggcuggggcaacggguguggacuguucggcaaagggagccuggugaccugcgcuaaguuugcgugcuccaagaaaaugacaggaaagagcauccagccugagaaucucgaauaccgcaucaugcugucuguccacggcucccaacacagcgggaugauugugaacgauaccggacaugagacggacgagaaucgggccaaaguugaaaucacaccgaacucucccagagcugaggccacccuuggcggcuucgggagccugggacucgauugugaaccucgcaccggccuggacuuuuccgaucuuuauuaccugacaaugaauaacaagcacuggcucgugcauaaagagugguuccacgacauuccccugccuuggcacgccggggcugauaccggaacaccccauuggaauaacaaggaagcccuggucgaguuuaaagacgcgcacgcuaagcggcagacgguggucgugcucggcucucaggagggggccguucauaccgcccuggcuggcgcccuugaagcugagauggauggagccaagggcagacugagcuccgggcaccucaaaugccgccugaagauggacaaacuucggcugaagggagugagcuauucucucuguacagcggccuucaccuuuacaaaaaucccggcugaaacccugcauggcacggucaccguggagguucaguacgccgggacagacggaccuugcaaggugcccgcucaaauggccgucgauaugcagacccugacaccugugggcagacucauuaccgcgaaccccgugaucacggaauccacagagaauagcaagaugaugcuggagcuugaucccccuuucggggacucuuacaucguuauuggcgucggagagaaaaagaucacccaccacuggcaucgcuccggcagcacaauugggaaagccuuugaagcuaccgugcggggagccaagagaauggcugugcugggcgacaccgccugggauuucggguccgucggaggcgcccucaacucucuggggaaaggcauccaccagauuuucggagcugcguuuaagagccuguucggcgggauguccugguuuucucaaauccuuaucggaacacuccugauguggcugggccucaauacgaagaacgggagcauuucccugaugugucuugcccugggaggcgugcucaucuuccugagcaccgcuguuucugccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8900 - RNA, 2323 nt, Artificial Sequence
  ZIKV prME variant mRNA Design 3 opt
gggagaaagcuuaccauggccagaaaggagaaaaagcggcgcggcgcugacaccagcguggggaucgucggacugcuccugacaacggccauggcggcugaaguuaccagacggggcuccgccuacuauauguaccuugaucgcaacgacgccggggaggcuauuucuuuccccacaacccugggaaugaauaaaugcuauauccagauuauggaucucggccacaugugugacgccacaaugagcuacgaaugcccuaugcuggaugaggggguggaaccggacgauguggacuguuggugcaacaccacauccaccugggucguguauggaacgugucaucacaagaaaggcgaggcuagacggucucgcagagccguuacccuucccagccauuccacacggaagcugcaaacccgcucucagacauggcucgagagcagagaauacaccaagcaccugauccggguggagaauuggauuuuucgcaacccuggcuucgcgcuggccgcugccgcuaucgccuggcuccugggguccagcacgucucagaaagucaucuaucuugugaugauucugcucaucgcgcccgccuacuccauuagaugcaucggaguuagcaaucgggauuuuguggaaggcaugucugggggaacaugggucgacauugugcuggagcauggcgggugugugaccgucauggcucaggauaagccuacaguugacaucgagcuugugaccaccacaguguccaacauggccgaaguccgcagcuacugcuaugaggcuucuauuuccgauauggccagcgacuccagaugucccacgcaaggagaagccuaccuggacaaacagucugauacccaguaugugugcaagcggacacucguugacagaggcuggggcaauggguguggacuguucggcaaagggagccuggugaccugcgcuaaguuugcgugcuccaagaaaaugacaggaaagagcauccagccugagaaccucgaauaccgcaucaugcugucuguccacggcucccaacacagcgggaugauugugaaugauaccggacaugagacggacgagaaccgggccaaaguugaaaucacacccaauucucccagagcugaggccacccuuggcggcuucgggagccugggacucgauugugaaccucgcaccggccuggacuuuuccgaucuuuauuaccugacaaugaacaauaagcacuggcucgugcauaaagagugguuccacgacauuccccugccuuggcacgccggggcugauaccggaacaccccauuggaacaauaaggaagcccuggucgaguuuaaagacgcgcacgcuaagcggcagacgguggucgugcucggcucucaggagggggccguucauaccgcccuggcuggcgcccuugaagcugagauggauggagccaagggcagacugagcuccgggcaccucaaaugccgccugaagauggacaaacuucggcugaagggagugagcuauucucucuguacagcggccuucaccuuuacaaaaaucccggcugaaacccugcauggcacggucaccguggagguucaguacgccgggacagacggaccuugcaaggugcccgcucaaauggccgucgauaugcagacccugacaccugugggcagacucauuaccgcgaaccccgugaucacggaauccacagagaacagcaagaugaugcuggagcuugacccgccuuucggggauucuuacaucguuauuggcgucggagagaaaaagaucacccaccacuggcaucgcuccggcagcacaauugggaaagccuuugaagcuaccgugcggggagccaagagaauggcugugcugggcgacaccgccugggauuucggguccgucggaggcgcccucaauucucuggggaaaggcauccaccagauuuucggagcugcguuuaagagccuguucggcgggauguccugguuuucucaaauccuuaucggaacacuccugauguggcugggccucaacacgaagaaugggagcauuucccugaugugucuugcccugggaggcgugcucaucuuccugagcaccgcuguuucugccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8901 - RNA, 2320 nt, Artificial Sequence
  ZIKV prME variant mRNA Design 3 opt
gggagaaagcuuaccaugagaaaggagaaaaagcggcgcggcgccgacaccagcguggggaucgucggacugcuccugacaacggcuauggccgcggaaguuaccagacggggcuccgcuuacuauauguaccuugaucgcaacgacgccggggaggccauuucuuuccccacaacccugggaaugaauaaaugcuauauccagauuauggaucucggccacaugugugacgcuacaaugagcuacgaaugcccuaugcuggaugaggggguggaaccggacgauguggacuguuggugcaacaccacauccaccugggucguguauggaacgugucaucacaagaaaggcgaggccagacggucucgcagagcuguuacccuucccagccauuccacacggaagcugcaaacccgcucucagacauggcucgagagcagagaauacaccaagcaccugauccggguggagaauuggauuuuucgcaacccuggcuucgcccuggcggccgcugccaucgcuuggcuccugggguccagcacgucucagaaagucaucuaucuugugaugauucugcucaucgcccccgcguacuccauuagaugcaucggaguuagcaaucgggauuuuguggaaggcaugucugggggaacaugggucgacauugugcuggagcauggcgggugugugaccgucauggcccaggauaagccuacaguugacaucgagcuugugaccaccacaguguccaacauggcugaaguccgcagcuacugcuaugaggccucuauuuccgauauggcuagcgacuccagaugucccacgcaaggagaagccuaccuggacaaacagucugauacccaguaugugugcaagcggacacucguugacagaggcuggggcaauggguguggacuguucggcaaagggagccuggugaccugcgccaaguuugcuugcuccaagaaaaugacaggaaagagcauccagccugagaaccucgaauaccgcaucaugcugucuguccacggcucccaacacagcgggaugauugugaaugauaccggacaugagacggacgagaaccgggcgaaaguugaaaucacacccaauucucccagagccgaggcuacccuuggcggcuucgggagccugggacucgauugugaaccucgcaccggccuggacuuuuccgaucuuuauuaccugacaaugaacaauaagcacuggcucgugcauaaagagugguuccacgacauuccccugccuuggcacgccggggccgauaccggaacaccccauuggaacaauaaggaagcucuggucgaguuuaaagacgcccacgcgaagcggcagacgguggucgugcucggcucucaggagggggcuguucauaccgcccuggccggcgcucuugaagccgagauggauggagcuaagggcagacugagcuccgggcaccucaaaugccgccugaagauggacaaacuucggcugaagggagugagcuauucucucuguacagccgcguucaccuuuacaaaaaucccggccgaaacccugcauggcacggucaccguggagguucaguacgcugggacagacggaccuugcaaggugcccgcccaaauggcugucgauaugcagacccugacaccugugggcagacucauuaccgccaaccccgugaucacggaauccacagagaacagcaagaugaugcuggagcuugacccgccuuucggggauucuuacaucguuauuggcgucggagagaaaaagaucacccaccacuggcaucgcuccggcagcacaauugggaaagcguuugaagccaccgugcggggagcuaagagaauggccgugcugggcgacaccgcuugggauuucggguccgucggaggcgcccucaauucucuggggaaaggcauccaccagauuuucggagccgcuuuuaagagccuguucggcgggauguccugguuuucucaaauccuuaucggaacacuccugauguggcugggccucaacacgaagaaugggagcauuucccugaugugucuugcgcugggaggcgugcucaucuuccugagcaccgccguuucugcuugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8902 - RNA, 2317 nt, Artificial Sequence
  ZIKV prME variant mRNA Design 3 opt
gggagaaagcuuaccaugaaggagaaaaagagacggggcgccgacaccagcguggggaucgucggacugcuccugacaacggcuauggccgcggaaguuacccgcagaggcuccgcuuacuauauguaccuugaucggaacgacgccggggaggccauuucuuuccccacaacccugggaaugaauaaaugcuauauccagauuauggaucucggccacaugugugacgcuacaaugagcuacgaaugcccuaugcuggaugaggggguggaaccggacgauguggacuguuggugcaacaccacauccaccugggucguguauggaacgugucaucacaagaaaggcgaggcccgcagaucucggcgcgcuguuacccuucccagccauuccacaagaaagcugcaaacccggucucagacauggcucgagagccgcgaauacaccaagcaccugaucagaguggagaauuggauuuuucggaacccuggcuucgcccuggcggccgcugccaucgcuuggcuccugggguccagcacgucucagaaagucaucuaucuugugaugauucugcucaucgcccccgcguacuccauucgcugcaucggaguuagcaauagagauuuuguggaaggcaugucugggggaacaugggucgacauugugcuggagcauggcgggugugugaccgucauggcccaggauaagccuacaguugacaucgagcuugugaccaccacaguguccaacauggcugaaguccggagcuacugcuaugaggccucuauuuccgauauggcuagcgacucccgcugucccacgcaaggagaagccuaccuggacaaacagucugauacccaguaugugugcaagagaacacucguugaccggggcuggggcaauggguguggacuguucggcaaagggagccuggugaccugcgccaaguuugcuugcuccaagaaaaugacaggaaagagcauccagccugagaaccucgaauacagaaucaugcugucuguccacggcucccaacacagcgggaugauugugaaugauaccggacaugagacggacgagaaccgcgcgaaaguugaaaucacacccaauucuccccgggccgaggcuacccuuggcggcuucgggagccugggacucgauugugaaccuagaaccggccuggacuuuuccgaucuuuauuaccugacaaugaacaauaagcacuggcucgugcauaaagagugguuccacgacauuccccugccuuggcacgccggggccgauaccggaacaccccauuggaacaauaaggaagcucuggucgaguuuaaagacgcccacgcgaagcgccagacgguggucgugcucggcucucaggagggggcuguucauaccgcccuggccggcgcucuugaagccgagauggauggagcuaagggccggcugagcuccgggcaccucaaaugcagacugaagauggacaaacuucgccugaagggagugagcuauucucucuguacagccgcguucaccuuuacaaaaaucccggccgaaacccugcauggcacggucaccguggagguucaguacgcugggacagacggaccuugcaaggugcccgcccaaauggcugucgauaugcagacccugacaccugugggccggcucauuaccgccaaccccgugaucacggaauccacagagaacagcaagaugaugcuggagcuugacccgccuuucggggauucuuacaucguuauuggcgucggagagaaaaagaucacccaccacuggcauagauccggcagcacaauugggaaagcguuugaagccaccgugcgcggagcuaagcggauggccgugcugggcgacaccgcuugggauuucggguccgucggaggcgcccucaauucucuggggaaaggcauccaccagauuuucggagccgcuuuuaagagccuguucggcgggauguccugguuuucucaaauccuuaucggaacacuccugauguggcugggccucaacacgaagaaugggagcauuucccugaugugucuugcgcugggaggcgugcucaucuuccugagcaccgccguuucugcuugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8903 - RNA, 2314 nt, Artificial Sequence
  ZIKV prME variant mRNA Design 3 opt
gggagaaagcuuaccauggagaagaaaagacggggcgccgacaccagcguggggaucgucggacugcuccugacaacggcuauggccgcggaaguuacccgcagaggcuccgcuuacuauauguaccuugaucggaacgacgccggggaggccauuucuuuccccacaacccugggaaugaauaagugcuauauccagauuauggaucucggccacaugugugacgcuacaaugagcuacgaaugcccuaugcuggaugaggggguggaaccggacgauguggacuguuggugcaacaccacauccaccugggucguguauggaacgugucaucacaaaaagggcgaggcccgcagaucucggcgcgcuguuacccuucccagccauuccacaagaaaacugcaaacccggucucagacauggcucgagagccgcgaauacaccaagcaccugaucagaguggagaauuggauuuuucggaacccuggcuucgcccuggcggccgcugccaucgcuuggcuccugggguccagcacgucucagaaggucaucuaucuugugaugauucugcucaucgcccccgcguacuccauucgcugcaucggaguuagcaauagagauuuuguggaaggcaugucugggggaacaugggucgacauugugcuggagcauggcgggugugugaccgucauggcccaggauaaaccuacaguugacaucgagcuugugaccaccacaguguccaacauggcugaaguccggagcuacugcuaugaggccucuauuuccgauauggcuagcgacucccgcugucccacgcaaggagaagccuaccuggacaagcagucugauacccaguaugugugcaaaagaacacucguugaccggggcuggggcaauggguguggacuguucggcaaggggagccuggugaccugcgccaaauuugcuugcuccaagaagaugacaggaaaaagcauccagccugagaaccucgaauacagaaucaugcugucuguccacggcucccaacacagcgggaugauugugaaugauaccggacaugagacggacgagaaccgcgcgaagguugaaaucacacccaauucuccccgggccgaggcuacccuuggcggcuucgggagccugggacucgauugugaaccuagaaccggccuggacuuuuccgaucuuuauuaccugacaaugaacaauaaacacuggcucgugcauaaggagugguuccacgacauuccccugccuuggcacgccggggccgauaccggaacaccccauuggaacaauaaagaagcucuggucgaguuuaaggacgcccacgcgaaacgccagacgguggucgugcucggcucucaggagggggcuguucauaccgcccuggccggcgcucuugaagccgagauggauggagcuaagggccggcugagcuccgggcaccucaagugcagacugaaaauggacaaacuucgccugaagggagugagcuauucucucuguacagccgcguucaccuuuacaaagaucccggccgaaacccugcauggcacggucaccguggagguucaguacgcugggacagacggaccuugcaaagugcccgcccaaauggcugucgauaugcagacccugacaccugugggccggcucauuaccgccaaccccgugaucacggaauccacagagaacagcaagaugaugcuggagcuugacccgccuuucggggauucuuacaucguuauuggcgucggagaaaagaaaaucacccaccacuggcauagauccggcagcacaauugggaaggcguuugaggccaccgugcgcggagcuaaacggauggccgugcugggcgacaccgcuugggauuucggguccgucggaggcgcccucaauucucuggggaagggcauccaccagauuuucggagccgcuuuuaaaagccuguucggcgggauguccugguuuucucaaauccuuaucggaacacuccugauguggcugggccucaacacgaagaaugggagcauuucccugaugugucuugcgcugggaggcgugcucaucuuccugagcaccgccguuucugcuugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8904 - RNA, 2311 nt, Artificial Sequence
  ZIKV prME variant mRNA Design 3 opt
gggagaaagcuuaccaugaagaaaagacggggcgccgacaccagcguggggaucgucggacugcuccugacaacggcuauggccgcggagguuacccgcagaggcuccgcuuacuauauguaccuugaucggaacgacgccggggaagccauuucuuuccccacaacccugggaaugaauaagugcuauauccagauuauggaucucggccacaugugugacgcuacaaugagcuacgagugcccuaugcuggaugaagggguggagccggacgauguggacuguuggugcaacaccacauccaccugggucguguauggaacgugucaucacaaaaagggcgaagcccgcagaucucggcgcgcuguuacccuucccagccauuccacaagaaaacugcaaacccggucucagacauggcucgagagccgcgaguacaccaagcaccugaucagaguggaaaauuggauuuuucggaacccuggcuucgcccuggcggccgcugccaucgcuuggcuccugggguccagcacgucucagaaggucaucuaucuugugaugauucugcucaucgcccccgcguacuccauucgcugcaucggaguuagcaauagagauuuuguggagggcaugucugggggaacaugggucgacauugugcuggaacauggcgggugugugaccgucauggcccaggauaaaccuacaguugacaucgagcuugugaccaccacaguguccaacauggcugagguccggagcuacugcuaugaagccucuauuuccgauauggcuagcgacucccgcugucccacgcaaggagaggccuaccuggacaagcagucugauacccaguaugugugcaaaagaacacucguugaccggggcuggggcaauggguguggacuguucggcaaggggagccuggugaccugcgccaaauuugcuugcuccaagaagaugacaggaaaaagcauccagccugaaaaccucgaguacagaaucaugcugucuguccacggcucccaacacagcgggaugauugugaaugauaccggacaugaaacggacgagaaccgcgcgaagguugagaucacacccaauucuccccgggccgaagcuacccuuggcggcuucgggagccugggacucgauugugagccuagaaccggccuggacuuuuccgaucuuuauuaccugacaaugaacaauaaacacuggcucgugcauaaggaaugguuccacgacauuccccugccuuggcacgccggggccgauaccggaacaccccauuggaacaauaaagaggcucuggucgaauuuaaggacgcccacgcgaaacgccagacgguggucgugcucggcucucaggagggggcuguucauaccgcccuggccggcgcucuugaggccgaaauggauggagcuaagggccggcugagcuccgggcaccucaagugcagacugaaaauggacaaacuucgccugaagggagugagcuauucucucuguacagccgcguucaccuuuacaaagaucccggccgagacccugcauggcacggucaccguggaaguucaguacgcugggacagacggaccuugcaaagugcccgcccaaauggcugucgauaugcagacccugacaccugugggccggcucauuaccgccaaccccgugaucacggaguccacagaaaacagcaagaugaugcuggagcuugacccgccuuucggggauucuuacaucguuauuggcgucggagagaagaaaaucacccaccacuggcauagauccggcagcacaauugggaaggcguuugaagccaccgugcgcggagcuaaacggauggccgugcugggcgacaccgcuugggauuucggguccgucggaggcgcccucaauucucuggggaagggcauccaccagauuuucggagccgcuuuuaaaagccuguucggcgggauguccugguuuucucaaauccuuaucggaacacuccugauguggcugggccucaacacgaagaaugggagcauuucccugaugugucuugcgcugggaggcgugcucaucuuccugagcaccgccguuucugcuugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8905 - RNA, 2308 nt, Artificial Sequence
  ZIKV prME variant mRNA Design 3 opt
gggagaaagcuuaccaugaagagacggggcgccgacaccagcguggggaucgucggacugcuccugacaacggcuauggccgcggagguuacccgcagaggcuccgcuuacuauauguaccuugaucggaacgacgccggggaagccauuucuuuccccacaacccugggaaugaauaaaugcuauauccagauuauggaucucggccacaugugugacgcuacaaugagcuacgagugcccuaugcuggaugaagggguggagccggacgauguggacuguuggugcaacaccacauccaccugggucguguauggaacgugucaucacaagaaaggcgaagcccgcagaucucggcgcgcuguuacccuucccagccauuccacaagaaagcugcaaacccggucucagacauggcucgagagccgcgaguacaccaaacaccugaucagaguggaaaauuggauuuuucggaacccuggcuucgcccuggcggccgcugccaucgcuuggcuccugggguccagcacgucucagaaggucaucuaucuugugaugauucugcucaucgcccccgcguacuccauucgcugcaucggaguuagcaauagagauuuuguggagggcaugucugggggaacaugggucgacauugugcuggaacauggcgggugugugaccgucauggcccaggauaagccuacaguugacaucgagcuugugaccaccacaguguccaacauggcugagguccggagcuacugcuaugaagccucuauuuccgauauggcuagcgacucccgcugucccacgcaaggagaggccuaccuggacaaacagucugauacccaguaugugugcaagagaacacucguugaccggggcuggggcaauggguguggacuguucggcaaagggagccuggugaccugcgccaaguuugcuugcuccaaaaagaugacaggaaagagcauccagccugaaaaccucgaguacagaaucaugcugucuguccacggcucccaacacagcgggaugauugugaaugauaccggacaugaaacggacgagaaccgcgcgaaaguugagaucacacccaauucuccccgggccgaagcuacccuuggcggcuucgggagccugggacucgauugugagccuagaaccggccuggacuuuuccgaucuuuauuaccugacaaugaacaauaagcacuggcucgugcauaaagaaugguuccacgacauuccccugccuuggcacgccggggccgauaccggaacaccccauuggaacaauaaggaggcucuggucgaauuuaaagacgcccacgcgaagcgccagacgguggucgugcucggcucucaggagggggcuguucauaccgcccuggccggcgcucuugaggccgaaauggauggagcuaaaggccggcugagcuccgggcaccucaagugcagacugaagauggacaaacuucgccugaagggagugagcuauucucucuguacagccgcguucaccuuuacaaaaaucccggccgagacccugcauggcacggucaccguggaaguucaguacgcugggacagacggaccuugcaaggugcccgcccaaauggcugucgauaugcagacccugacaccugugggccggcucauuaccgccaaccccgugaucacggaguccacagaaaacagcaaaaugaugcuggagcuugacccgccuuucggggauucuuacaucguuauuggcgucggagagaagaagaucacccaccacuggcauagauccggcagcacaauugggaaagcguuugaagccaccgugcgcggagcuaagcggauggccgugcugggcgacaccgcuugggauuucggguccgucggaggcgcccucaauucucuggggaaaggcauccaccagauuuucggagccgcuuuuaagagccuguucggcgggauguccugguuuucucaaauccuuaucggaacacuccugauguggcugggccucaacacgaaaaaugggagcauuucccugaugugucuugcgcugggaggcgugcucaucuuccugagcaccgccguuucugcuugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8906 - RNA, 2305 nt, Artificial Sequence
  ZIKV prME variant mRNA Design 3 opt
gggagaaagcuuaccaugagacggggcgccgacaccagcguggggaucgucggacugcuccugacaacggcuauggccgcggagguuacccgcagaggcuccgcuuacuauauguaccuugaucggaacgacgccggggaagccauuucuuuccccacaacccugggaaugaauaagugcuauauccagauuauggaucucggccacaugugugacgcuacaaugagcuacgagugcccuaugcuggaugaagggguggagccggacgauguggacuguuggugcaacaccacauccaccugggucguguauggaacgugucaucacaaaaagggcgaagcccgcagaucucggcgcgcuguuacccuucccagccauuccacaagaaaacugcaaacccggucucagacauggcucgagagccgcgaguacaccaagcaccugaucagaguggaaaauuggauuuuucggaacccuggcuucgcccuggcggccgcugccaucgcuuggcuccugggguccagcacgucucagaaagucaucuaucuugugaugauucugcucaucgcccccgcguacuccauucgcugcaucggaguuagcaauagagauuuuguggagggcaugucugggggaacaugggucgacauugugcuggaacauggcgggugugugaccgucauggcccaggauaagccuacaguugacaucgagcuugugaccaccacaguguccaacauggcugagguccggagcuacugcuaugaagccucuauuuccgauauggcuagcgacucccgcugucccacgcaaggagaggccuaccuggacaagcagucugauacccaguaugugugcaaaagaacacucguugaccggggcuggggcaauggguguggacuguucggcaaggggagccuggugaccugcgccaaauuugcuugcuccaagaaaaugacaggaaagagcauccagccugaaaaccucgaguacagaaucaugcugucuguccacggcucccaacacagcgggaugauugugaaugauaccggacaugaaacggacgagaaccgcgcgaagguugagaucacacccaauucuccccgggccgaagcuacccuuggcggcuucgggagccugggacucgauugugagccuagaaccggccuggacuuuuccgaucuuuauuaccugacaaugaacaauaaacacuggcucgugcauaaggaaugguuccacgacauuccccugccuuggcacgccggggccgauaccggaacaccccauuggaacaauaaagaggcucuggucgaauuuaaggacgcccacgcgaaacgccagacgguggucgugcucggcucucaggagggggcuguucauaccgcccuggccggcgcucuugaggccgaaauggauggagcuaagggccggcugagcuccgggcaccucaaaugcagacugaagauggacaaacuucgccugaagggagugagcuauucucucuguacagccgcguucaccuuuacaaagaucccggccgagacccugcauggcacggucaccguggaaguucaguacgcugggacagacggaccuugcaaagugcccgcccaaauggcugucgauaugcagacccugacaccugugggccggcucauuaccgccaaccccgugaucacggaguccacagaaaacagcaagaugaugcuggagcuugacccgccuuucggggauucuuacaucguuauuggcgucggagagaaaaagaucacccaccacuggcauagauccggcagcacaauugggaaggcguuugaagccaccgugcgcggagcuaaacggauggccgugcugggcgacaccgcuugggauuucggguccgucggaggcgcccucaauucucuggggaagggcauccaccagauuuucggagccgcuuuuaaaagccuguucggcgggauguccugguuuucucaaauccuuaucggaacacuccugauguggcugggccucaacacgaagaaugggagcauuucccugaugugucuugcgcugggaggcgugcucaucuuccugagcaccgccguuucugcuugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8907 - RNA, 2302 nt, Artificial Sequence
  ZIKV prME variant mRNA Design 3 opt
gggagaaagcuuaccaugagaggcgccgacaccagcguggggaucgucggacugcuccugacaacggcuauggccgcggagguuacccggcgcggcuccgcuuacuauauguaccuugauagaaacgacgccggggaagccauuucuuuccccacaacccugggaaugaauaagugcuauauccagauuauggaucucggccacaugugugacgcuacaaugagcuacgagugcccuaugcuggaugaagggguggagccggacgauguggacuguuggugcaacaccacauccaccugggucguguauggaacgugucaucacaaaaagggcgaagcccggcgcucuagacgggcuguuacccuucccagccauuccacacgcaaacugcaaaccagaucucagacauggcucgagagccgggaguacaccaagcaccugauccgcguggaaaauuggauuuuuagaaacccuggcuucgcccuggcggccgcugccaucgcuuggcuccugggguccagcacgucucagaaagucaucuaucuugugaugauucugcucaucgcccccgcguacuccauucggugcaucggaguuagcaaucgcgauuuuguggagggcaugucugggggaacaugggucgacauugugcuggaacauggcgggugugugaccgucauggcccaggauaagccuacaguugacaucgagcuugugaccaccacaguguccaacauggcugaggucagaagcuacugcuaugaagccucuauuuccgauauggcuagcgacucccggugucccacgcaaggagaggccuaccuggacaagcagucugauacccaguaugugugcaaacgcacacucguugacagaggcuggggcaauggguguggacuguucggcaaggggagccuggugaccugcgccaaauuugcuugcuccaagaaaaugacaggaaagagcauccagccugaaaaccucgaguaccggaucaugcugucuguccacggcucccaacacagcgggaugauugugaaugauaccggacaugaaacggacgagaacagagcgaagguugagaucacacccaauucuccccgcgccgaagcuacccuuggcggcuucgggagccugggacucgauugugagccucggaccggccuggacuuuuccgaucuuuauuaccugacaaugaacaauaaacacuggcucgugcauaaggaaugguuccacgacauuccccugccuuggcacgccggggccgauaccggaacaccccauuggaacaauaaagaggcucuggucgaauuuaaggacgcccacgcgaaaagacagacgguggucgugcucggcucucaggagggggcuguucauaccgcccuggccggcgcucuugaggccgaaauggauggagcuaagggccgccugagcuccgggcaccucaaaugccggcugaagauggacaaacuuagacugaagggagugagcuauucucucuguacagccgcguucaccuuuacaaagaucccggccgagacccugcauggcacggucaccguggaaguucaguacgcugggacagacggaccuugcaaagugcccgcccaaauggcugucgauaugcagacccugacaccugugggccgccucauuaccgccaaccccgugaucacggaguccacagaaaacagcaagaugaugcuggagcuugacccgccuuucggggauucuuacaucguuauuggcgucggagagaaaaagaucacccaccacuggcaucgguccggcagcacaauugggaaggcguuugaagccaccgugagaggagcuaaacgcauggccgugcugggcgacaccgcuugggauuucggguccgucggaggcgcccucaauucucuggggaagggcauccaccagauuuucggagccgcuuuuaaaagccuguucggcgggauguccugguuuucucaaauccuuaucggaacacuccugauguggcugggccucaacacgaagaaugggagcauuucccugaugugucuugcgcugggaggcgugcucaucuuccugagcaccgccguuucugcuugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8908 - RNA, 2299 nt, Artificial Sequence
  ZIKV prME variant mRNA Design 3 opt
gggagaaagcuuaccaugggcgccgacaccagcguggggaucgucggacugcuccugacaacggcuauggccgcggagguuaccagacggggcuccgcuuacuauauguaccuugaucgcaacgacgccggggaagccauuucuuuccccacaacccugggaaugaauaagugcuauauccagauuauggaucucggccacaugugugacgcuacaaugagcuacgagugcccuaugcuggaugaagggguggagccggacgauguggacuguuggugcaacaccacauccaccugggucguguauggaacgugucaucacaaaaagggcgaagccagacggucucgcagagcuguuacccuucccagccauuccacacggaaacugcaaacccgcucucagacauggcucgagagcagagaguacaccaagcaccugauccggguggaaaauuggauuuuucgcaacccuggcuucgcccuggcggccgcugccaucgcuuggcuccugggguccagcacgucucagaaagucaucuaucuugugaugauucugcucaucgcccccgcguacuccauuagaugcaucggaguuagcaaucgggauuuuguggagggcaugucugggggaacaugggucgacauugugcuggaacauggcgggugugugaccgucauggcccaggauaagccuacaguugacaucgagcuugugaccaccacaguguccaacauggcugagguccgcagcuacugcuaugaagccucuauuuccgauauggcuagcgacuccagaugucccacgcaaggagaggccuaccuggacaagcagucugauacccaguaugugugcaaacggacacucguugaccgcggcuggggcaauggguguggacuguucggcaaggggagccuggugaccugcgccaaauuugcuugcuccaagaaaaugacaggaaagagcauccagccugaaaaccucgaguacagaaucaugcugucuguccacggcucccaacacagcgggaugauugugaaugauaccggacaugaaacggacgagaaccgggcgaagguugagaucacacccaauucucccagagccgaagcuacccuuggcggcuucgggagccugggacucgauugugagccucgcaccggccuggacuuuuccgaucuuuauuaccugacaaugaacaauaaacacuggcucgugcauaaggaaugguuccacgacauuccccugccuuggcacgccggggccgauaccggaacaccccauuggaacaauaaagaggcucuggucgaauuuaaggacgcccacgcgaaacggcagacgguggucgugcucggcucucaggagggggcuguucauaccgcccuggccggcgcucuugaggccgaaauggauggagcuaagggcagacugagcuccgggcaccucaaaugccgccugaagauggacaaacuucggcugaagggagugagcuauucucucuguacagccgcguucaccuuuacaaagaucccggccgagacccugcauggcacggucaccguggaaguucaguacgcugggacagacggaccuugcaaagugcccgcccaaauggcugucgauaugcagacccugacaccugugggcagacucauuaccgccaaccccgugaucacggaguccacagaaaacagcaagaugaugcuggagcuugacccgccuuucggggauucuuacaucguuauuggcgucggagagaaaaagaucacccaccacuggcaucgcuccggcagcacaauugggaaggcguuugaagccaccgugcggggagcuaaaagaauggccgugcugggcgacaccgcuugggauuucggguccgucggaggcgcccucaauucucuggggaagggcauccaccagauuuucggagccgcuuuuaaaagccuguucggcgggauguccugguuuucucaaauccuuaucggaacacuccugauguggcugggccucaacacgaagaaugggagcauuucccugaugugucuugcgcugggaggcgugcucaucuuccugagcaccgccguuucugcuugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8909 - RNA, 2296 nt, Artificial Sequence
  ZIKV prME variant mRNA Design 3 opt
gggagaaagcuuaccauggccgacaccagcgugggcaucgucgggcugcuccugacaacggcuauggccgcggagguuaccagacggggauccgcuuacuauauguaccuugaucgcaacgacgccggcgaagccauuucuuuccccacaacccuggggaugaauaagugcuauauccagauuauggaucucggacacaugugugacgcuacaaugagcuacgagugcccuaugcuggaugaaggcguggagccggacgauguggacuguuggugcaacaccacauccaccugggucguguaugggacgugucaucacaaaaagggagaagccagacggucucgcagagcuguuacccuucccagccauuccacacggaaacugcaaacccgcucucagacauggcucgagagcagagaguacaccaagcaccugauccggguggaaaauuggauuuuucgcaacccuggcuucgcccuggcggccgcugccaucgcuuggcuccugggcuccagcacgucucagaaagucaucuaucuugugaugauucugcucaucgcccccgcguacuccauuagaugcaucgggguuagcaaucgggauuuuguggagggaaugucuggcgggacaugggucgacauugugcuggaacauggaggcugugugaccgucauggcccaggauaagccuacaguugacaucgagcuugugaccaccacaguguccaacauggcugagguccgcagcuacugcuaugaagccucuauuuccgauauggcuagcgacuccagaugucccacgcaaggggaggccuaccuggacaagcagucugauacccaguaugugugcaaacggacacucguugaccgcggauggggcaauggcugugggcuguucggaaagggcagccuggugaccugcgccaaauuugcuugcuccaagaaaaugacaggaaagagcauccagccugaaaaccucgaguacagaaucaugcugucuguccacgggucccaacacagcggcaugauugugaaugauaccgggcaugaaacggacgagaaccgggcgaagguugagaucacacccaauucucccagagccgaagcuacccuuggaggcuucggcagccuggggcucgauugugagccucgcaccggacuggacuuuuccgaucuuuauuaccugacaaugaacaauaaacacuggcucgugcauaaggaaugguuccacgacauuccccugccuuggcacgccggcgccgauaccgggacaccccauuggaacaauaaagaggcucuggucgaauuuaaggacgcccacgcgaaacggcagacgguggucgugcucggaucucaggagggcgcuguucauaccgcccuggccggggcucuugaggccgaaauggauggcgcuaagggaagacugagcuccggccaccucaaaugccgccugaagauggacaagcugcggcugaaaggggugagcuauucucucuguacagccgcguucaccuuuacaaagaucccggccgagacccugcauggaacggucaccguggaaguucaguacgcuggcacagacgggccuugcaaagugcccgcccaaauggcugucgauaugcagacccugacaccugugggaagacucauuaccgccaaccccgugaucacggaguccacagaaaacagcaagaugaugcuggagcuugacccgccuuucggcgauucuuacaucguuauuggggucggcgagaaaaagaucacccaccacuggcaucgcuccggaagcacaauuggcaaggcguuugaagccaccgugagaggggcuaaacggauggccgugcugggagacaccgcuugggauuucggcuccgucgggggagcccucaauucucugggcaaggggauccaccagauuuucggcgccgcuuuuaaaagccuguucggaggcauguccugguuuucucaaauccuuaucgggacacuccugauguggcugggacucaacacgaagaauggcagcauuucccugaugugucuugcgcuugggggagugcucaucuuccugagcaccgccguuucugcuugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8910 - RNA, 2293 nt, Artificial Sequence
  ZIKV prME variant mRNA Design 3 opt
gggagaaagcuuaccauggacaccagcgugggcaucgucgggcugcuccugacaacggccauggcugccgagguuaccagacggggauccgcguacuauauguaccuugaucgcaacgacgcuggcgaagccauuucuuuccccacaacccuggggaugaauaagugcuauauccagauuauggaucucggacacaugugugacgccacaaugagcuacgagugcccuaugcuggaugaaggcguggagccggacgauguggacuguuggugcaacaccacauccaccugggucguguaugggacgugucaucacaaaaagggagaagcuagacggucucgcagagccguuacccuucccagccauuccacacggaaacugcaaacccgcucucagacauggcucgagagcagagaguacaccaagcaccugauccggguggaaaauuggauuuuucgcaacccuggcuucgcucuggccgcggccgcuaucgccuggcuccugggcuccagcacgucucagaaagucaucuaucuugugaugauucugcucaucgcucccgccuacuccauuagaugcaucgggguuagcaaucgggauuuuguggagggaaugucuggcgggacaugggucgacauugugcuggaacauggaggcugugugaccgucauggcgcaggauaagccuacaguugacaucgagcuugugaccaccacaguguccaacauggccgagguccgcagcuacugcuaugaagcuagcauuuccgauauggccagcgacuccagaugucccacgcaaggggaggcuuaccuggacaagcagucugauacccaguaugugugcaaacggacacucguugaccgcggauggggcaauggcugugggcuguucggaaagggcagccuggugaccugcgccaaauuugccugcuccaagaaaaugacagggaagucuauccagccugaaaaccucgaguacagaaucaugcugucuguccacggaucccaacacagcggcaugauugugaaugauaccgggcaugaaacggacgagaaccgggcuaagguugagaucacacccaauucucccagagcggaagccacccuuggaggcuucggcagccuggggcucgauugugagccucgcaccggacuggacuuuuccgaucuuuauuaccugacaaugaacaauaaacacuggcucgugcauaaggaaugguuccacgacauuccccugccuuggcacgcuggcgccgauaccgggacaccccauuggaacaauaaagaggcccuggucgaauuuaaggacgcucacgccaaacggcagacgguggucgugcucggaucucaggagggcgcgguucauaccgcucuggccggggcccuugaggcugaaauggauggcgccaagggaagacugagcuccggccaccucaaaugccgccugaagauggacaagcugcggcugaaaggggugagcuauucucucuguacagcugccuucaccuuuacaaagaucccggcggagacccugcauggaacggucaccguggaaguucaguacgccggcacagacgggccuugcaaagugcccgcucaaauggccgucgauaugcagacccugacaccugugggaagacucauuaccgcuaaccccgugaucacggaguccacagaaaacagcaagaugaugcuggagcuugacccgccuuucggcgauucuuacaucguuauuggggucggcgagaaaaagaucacccaccacuggcaucgcuccggaagcacaauuggcaaggccuuugaagcgaccgugagaggggccaaacggauggcugugcugggagacaccgccugggauuucggcuccgucgggggagcucucaauucucugggcaaggggauccaccagauuuucggcgccgccuuuaaaagccuguucggaggcauguccugguuuucucaaauccuuaucgggacacuccugauguggcugggacucaacacgaagaauggcagcauuucccugaugugucuugcucuugggggagugcucaucuuccugagcaccgcgguuucugccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8911 - RNA, 2290 nt, Artificial Sequence; identical to SEQ ID NO: 8817
  ZIKV (strain ZikaSPH2015) Polyprotein(108-794) mRNA Design 3 opt

SEQ ID NO: 8912 - RNA, 2290 nt, Artificial Sequence
  ZIKV prME variant mRNA Design 3 opt
gggagaaagcuuaccaugaccagcgugggcaucgucgggcugcuccugacaacggccauggcugccgcgguuaccagacggggauccgcuuacuauauguaccuugaccgcaacgaugccggcgaggccauuucuuuccccacaacccuggggaugaauaagugcuauauccagauuauggaccucggacacaugugugaugcuacaaugagcuacgaaugcccuaugcuggacgagggcguggaaccggaugacguggauuguuggugcaacaccacauccaccugggucguguaugggacgugucaucacaaaaagggagaggccagacggucucgcagagcuguuacccuucccagccauuccacacggaaacugcaaacccgcucucagacauggcucgaaagcagagaguacaccaagcaccugauccggguggagaauuggauuuuucgcaacccuggcuucgcccuggcggccgcugccaucgcuuggcuccugggcuccagcacgucucagaaagucaucuaucuugugaugauucugcucaucgcccccgcguacuccauuagaugcaucgggguuagcaaucgggacuuuguggaaggaaugucuggcgggacaugggucgauauugugcuggagcauggaggcugugugaccgucauggcccaggacaagccuacaguugauaucgaacuugugaccaccacaguguccaacauggcugagguccgcagcuacugcuaugaggccucuauuuccgacauggcuagcgauuccagaugucccacgcaaggggaagccuaccuggacaagcagucugacacccaguaugugugcaaacggacacucguugaucgcggauggggcaauggcugugggcuguucggaaagggcagccuggugaccugcgccaaauuugcuugcuccaagaaaaugacagggaagucuauccagccugagaaccucgaauacagaaucaugcugucuguccacggaucccaacacagcggcaugauugugaaugacaccgggcaugagacggaugaaaaccgggcgaagguugagaucacaccgaauagccccagagccgaggcuacccuuggaggcuucggcagccuggggcucgacugugaaccucgcaccggacuggauuuuuccgaccuuuauuaccugacaaugaacaauaaacacuggcucgugcauaaggagugguuccacgauauuccccugccuuggcacgccggcgccgacaccgggacaccccauuggaacaauaaagaagcucuggucgaguuuaaggaugcccacgcgaaacggcagacgguggucgugcucggaucucaggaaggcgcuguucauaccgcccuggccggggcucuugaggccgagauggacggcgcuaagggaagacugagcuccggccaccucaaaugccgccugaagauggauaagcugcggcugaaaggggugagcuauucucucuguacagccgcguucaccuuuacaaagaucccggccgaaacccugcauggaacggucaccguggagguucaguacgcuggcacagacgggccuugcaaagugcccgcccaaauggcugucgacaugcagacccugacaccugugggaagacucauuaccgccaaccccgugaucacggaauccacagagaacagcaagaugaugcuggaacuugaucccccuuucggcgacucuuacaucguuauuggggucggcgagaaaaagaucacccaccacuggcaucgcuccggaagcacaauuggcaaggcguuugaggccaccgugagaggggcuaaacggauggccgugcugggagauaccgcuugggacuucggcuccgucgggggagcccucaauucucugggcaaggggauccaccagauuuucggcgccgcuuuuaaaagccuguucggaggcauguccugguuuucucaaauccuuaucgggacacuccugauguggcugggacucaacacgaagaauggcagcauuucccugaugugucuugcgcuugggggagugcucaucuuccugagcaccgccguuucugcuugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8913 - RNA, 2302 nt, Artificial Sequence
  ZIKV prME variant mRNA Design 3 opt
gggagaaagcuuaccaugagaggcgccgacaccagcguggggaucgucggacugcuccugacaacggcuauggccgcggcuguuacccggcgcggcuccgccuacuauauguaccuugauagaaacgacgccggggaggcuauuucuuuccccacaacccugggaaugaauaagugcuauauccagauuauggaucucggccacaugugugacgccacaaugagcuacgaaugcccuaugcuggaugaggggguggaaccggacgauguggacuguuggugcaacaccacauccaccugggucguguauggaacgugucaucacaaaaagggcgaggcucggcgcucuagacgggccguuacccuucccagccauuccacacgcaaacugcaaaccagaucucagacauggcucgaaagccgggaguacaccaagcaccugauccgcguggagaauuggauuuuuagaaacccuggcuucgcgcuggccgcugccgcuaucgccuggcuccugggguccagcacgucucagaaagucaucuaucuugugaugauucugcucaucgcgcccgccuacuccauucggugcaucggaguuagcaaucgcgauuuuguggaaggcaugucugggggaacaugggucgacauugugcuggagcauggcgggugugugaccgucauggcucaggauaagccuacaguugacaucgaacuugugaccaccacaguguccaacauggccgaggucagaagcuacugcuaugaggcuucuauuuccgauauggccagcgacucccggugucccacgcaaggagaagccuaccuggacaagcagucugauacccaguaugugugcaaacgcacacucguugacagaggcuggggcaauggguguggacuguucggcaaggggagccuggugaccugcgcuaaauuugcgugcuccaagaaaaugacaggaaagagcauccagccugagaaccucgaauaccggaucaugcugucuguccacggcucccaacacagcgggaugauugugaaugauaccggacaugagacggacgaaaacagagccaagguugagaucacacccaauucuccccgcgcugaggccacccuuggcggcuucgggagccugggacucgauugugaaccucggaccggccuggacuuuuccgaucuuuauuaccugacaaugaacaauaaacacuggcucgugcauaaggagugguuccacgacauuccccugccuuggcacgccggggcugauaccggaacaccccauuggaacaauaaagaagcccuggucgaguuuaaggacgcgcacgcuaaaagacagacgguggucgugcucggcucucaggaaggggccguucauaccgcccuggcuggcgcccuugaggcugagauggauggagccaagggccgccugagcuccgggcaccucaaaugccggcugaagauggacaaacuuagacugaagggagugagcuauucucucuguacagcggccuucaccuuuacaaagaucccggcugaaacccugcauggcacggucaccguggagguucaguacgccgggacagacggaccuugcaaagugcccgcucaaauggccgucgauaugcagacccugacaccugugggccgccucauuaccgcgaaccccgugaucacggaauccacagagaacagcaagaugaugcuggaacuugacccgccuuucggggauucuuacaucguuauuggcgucggagagaaaaagaucacccaccacuggcaucgguccggcagcacaauugggaaggccuuugaggcuaccgugagaggagccaaacgcauggcugugcugggcgacaccgccugggauuucggguccgucggaggcgcccucaauucucuggggaagggcauccaccagauuuucggagcugcguuuaaaagccuguucggcgggauguccugguuuucucaaauccuuaucggaacacuccugauguggcugggccucaacacgaagaaugggagcauuucccugaugugucuugcccugggaggcgugcucaucuuccugagcaccgcuguuucugccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8914 - RNA, 2326 nt, Artificial Sequence
  ZIKV prME variant mRNA Design 3 opt
gggagaaagcuuaccaugagaggccugagcucccggaagcgcagaucucacgacgugcucaccguccaguuccugauccuugggaugcugcucaugacaggaggcguuacgcggcgcgggagcgccuacuauauguaccuggauagaaacgacgcuggagaggccauuuccuuucccaccacacuuggcaugaauaaaugcuauauccaaauuauggaucuggggcauaugugugacgcgaccaugucuuacgaaugcccuaugcucgaugagggaguggaaccggacgauguggacuguuggugcaacacaaccagcacaugggucguguauggcaccugucaccauaagaaaggcgaggcucggcgcuccagacgggccguuacgcugcccucucacagcacccgcaagcugcagacaagaucccagaccuggcucgaaagccgggaguacacaaaacaucugauccgcguggagaauuggauuuucagaaacccuggguuugcccuugcugccgcugccaucgcguggcugcucggaucuuccaccagccagaaggucaucuaucuggugaugauucuucugaucgcccccgcuuacucuauucggugcaucggcguuuccaaucgcgauuucguggaagggaugagcggaggcacgugggucgacauugugcucgagcacgggggaugugugacagucauggcccaagauaagccuaccguugacaucgaacuggugacaaccaccgugucuaacauggcugaggucagauccuacugcuaugaggccagcauuuccgauauggcgucugacagccggugucccacacagggcgaagccuaccuggacaaacaguccgauacgcaguaugugugcaagagaacccucguugaccgcggcugggggaauggauguggccuguuugggaaaggaagccuugugacaugcgcuaaguucgccugcucuaaaaagaugaccggcaaguccauccaaccugagaaccuggaauaccggaucaugcucagcguccacgggucucagcauagcggaaugauugugaaugauacaggccacgagaccgacgaaaacagagcuaaaguugagaucacgcccaauuccccgcgcgccgaggccacacugggcggguuuggaucucuuggccuggauugugaaccucggaccgggcucgacuucagcgaucuguauuaccugaccaugaacaauaagcauuggcucgugcacaaagagugguuucacgacauuccccugccuuggcaugcuggagcggauacaggcacaccccacuggaacaauaaggaagcccuugucgaguucaaagacgcucaugccaagagacagacaguggucgugcuggggucccaggaaggcgccguucacacggcucucgccggagcgcuggaggcugagauggauggcgccaaagggcgccuuagcucuggacaucugaagugccggcucaagauggacaaacugagacugaagggcguguccuauagccucuguaccgccgcuuuuacauucaccaaaaucccggccgaaacacugcacgggaccgucacgguggagguucaauacgcuggaaccgacggcccuugcaaggugcccgcccagauggcggucgauaugcagacacuuaccccuguggggcgccugauuacagccaaccccgugaucaccgaaucuacggagaacuccaaaaugaugcucgaacuggaucccccuuuuggcgacagcuacaucguuauuggagucggcgagaagaagaucacacaccauuggcaccgguccgggucuaccauuggaaaggcuuucgaggccacagugagaggcgcuaaacgcauggccgugcugggggacaccgcgugggauuucggaagcgucggcggggcccuuaauucccucggcaaaggaauccaucaaauuuuuggcgcugccuucaagucucuguuugggggaaugagcugguucucccagauccugaucggcacccuccugauguggcuugggcugaacaccaaaaauggaagcauuucucucaugugucuggcucugggcggggugcuuaucuuucucuccacggccguuagcgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8915 - RNA, 2326 nt, Artificial Sequence
  ZIKV prME variant mRNA Design 3 opt
gggagaaagcuuaccaugagaggccugagcucccggaagcgcagaucucacgacgugcucaccguccaguuccugauccuugggaugcugcucaugacaggagccguuacgcggcgcggcagcgcuuacuauauguaccuggauagaaacgacgccggggaggcgauuuccuuucccaccacacuuggaaugaauaaaugcuauauccaaauuauggaucugggccauaugugugacgcuaccaugucuuacgaaugcccuaugcucgaugaggggguggaaccggacgauguggacuguuggugcaacacaaccagcacaugggucguguauggaaccugucaccauaagaaaggcgaggcccggcgcuccagacgggccguuacgcugcccucucacagcacccgcaagcugcagacaagaucccagaccuggcucgaaagccgggaguacacaaaacaucugauccgcguggagaauuggauuuucagaaacccuggcuuugcucuugccgcugccgcgaucgccuggcugcucgggucuuccaccagccagaaggucaucuaucuggugaugauucuucugaucgcucccgccuacucuauucggugcaucggaguuuccaaucgcgauuucguggaaggcaugagcgggggaacgugggucgacauugugcucgagcacggcgggugugugacagucauggcucaagauaagccuaccguugacaucgaacuggugacaaccaccgugucuaacauggccgaggucagauccuacugcuaugaggcgagcauuuccgauauggccucugacagccggugucccacacagggagaggcuuaccuggacaaacaguccgauacgcaguaugugugcaagagaacccucguugaccgcggcuggggcaauggguguggacuguuuggcaaagggagccuugugacaugcgccaaguucgcuugcucuaaaaagaugaccggaaaguccauccaaccugaaaaccuggaauaccggaucaugcucagcguccacggcucucagcauagcgggaugauugugaaugauacaggacacgagaccgacgaaaacagagccaaaguugagaucacgcccaauuccccgcgcgccgaggcuacacugggcggcuuugggucucuuggacuggauugugaaccucggaccggccucgacuucagcgaucuguauuaccugaccaugaacaauaagcauuggcucgugcacaaagagugguuucacgacauuccccugccuuggcaugcgggggccgauacaggaacaccccacuggaacaauaaggaagcucuugucgaguucaaagacgcccaugccaagagacagacaguggucgugcugggcucccaggaaggggcuguucacacggcccucgcgggcgcucuggaggccgagauggauggagccaaaggccgccuuagcucugggcaucugaagugccggcucaagauggacaaacugagacugaagggaguguccuauagccucuguaccgcugccuuuacauucaccaaaaucccggcugaaacacugcacggcaccgucacgguggagguucaauacgccgggaccgacggaccuugcaaggugcccgcgcagauggccgucgauaugcagacacuuaccccugugggccgccugauuacagcuaaccccgugaucaccgaaucuacggagaacuccaaaaugaugcucgaacuggaucccccuuuuggggacagcuacaucguuauuggcgucggagagaagaagaucacacaccauuggcaccgguccggcucuaccauugggaaagccuucgaggcuacagugagaggagccaagcgcauggcggugcugggcgacaccgccugggauuucgggagcgucggaggcgcucuuaauucccucgggaaaggcauccaucaaauuuuuggagccgcuuucaagucucuguuuggcgggaugagcugguucucccagauccugaucggaacccuccugauguggcuuggccugaacaccaaaaaugggagcauuucucucaugugucuggcccugggaggcgugcuuaucuuucucuccacggccguuagcgcuugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8916 - RNA, 2365 nt, Artificial Sequence; identical to SEQ ID NO: 8813
  KU321639.1 prME-long mRNA Design 3 opt

SEQ ID NO: 8917 - RNA, 2365 nt, Artificial Sequence; identical to SEQ ID NO: 8814
  KU312312.1 prME-long mRNA Design 3 opt

SEQ ID NO: 8918 - RNA, 2353 nt, Artificial Sequence; identical to SEQ ID NO: 8815
  AY632535.2 prME-long mRNA Design 3 opt

SEQ ID NO: 8919 - RNA, 2365 nt, Artificial Sequence; identical to SEQ ID NO: 8816
  KU527068.1 prME-long mRNA Design 3 opt

SEQ ID NO: 8920 - RNA, 2365 nt, Artificial Sequence
  KU720415.1 prME-long mRNA Design 3 opt
gggagaaagcuuaccaugagaaucauuaacgcccggaaggagcgcaaaagacggggcgcugacaccagcaucgggauuaucggacugcuccugacaacggccauggcggcugaaauuacccgcagaggcuccgccuacuauauguaccuugaucggucugacgccgggaaggcuaucagcuucgccacaacccugggagugaauaaaugccacguccagaucauggaucucggccauaugugugacgcuacaauguccuaugagugccccaugcuggaugaagggguugagcccgacgauguggacuguuggugcaacaccacaucuaccuggguggucuacggaacgugucaccauaagaaaggcgaagcccgcagaagccggcgcgcggugacccuuccgucccacucuacaagaaagcugcaaacccggagccagacauggcucgagucccgcgaguauaccaagcaucugauuaaaguugaaaauuggaucuuuagaaaccccggcuucgcccugguggcugucgccauugcuuggcuccuggggagcucuacgucccagaaggugaucuaccuuguuaugauucugcucaucgccccugcguauagcauucggugcaucggagugucuaaucgcgauuuugucgagggcauguccgggggaacauggguggacgugguccuggaacacggcggguguguuaccgugauggcccaggauaaacccacaguggacaucgagcuugucaccaccacagugagcaacauggcugagguuagaucuuacugcuacgaagccuccauuagcgauauggcuuccgacucucgguguccuacgcaaggagaggccuaucuggacaagcagagcgauacccaguacgugugcaaaagaacacucgucgaccgcggcuggggcaauggguguggacuguucggcaaggggucccuggugaccugcgccaaguuuacaugcagcaaaaagaugaccggaaaaucuauccagcccgaaaaccucgaguaucggauuaugcuguccguucacggcagccaacauucugggaugaucgugaaugauacgggauacgaaacagacgagaacagagcuaaggucgaggugaccccuaauagcccgcgcgcggaagccacccuuggcggcuucgggucccugggacucgauugugagccccggacaggccuggacuuuucugaucuuuauuaccugaccaugaacaauaaacacuggcucguccauaaggaaugguuccacgacauuccucugcccuggcacgcuggggccgauacaggaacgccucauuggaacaauaaagaggcccugguggaauuuaaggacgcucacgccaagagacagaccguugugguccucggcagccaggagggggcggugcauacagcucuggccggcgcccuugaggcugaaauggauggagccaaaggcaagcuguucuccgggcaccucaaaugccgccugaagauggacaaacuucggcugaagggaguuagcuauucucucuguaccgcugccuuuacauucaccaaggugcccgcggagacgcugcauggcaccgucacaguggaagugcaguacgccgggaccgacggaccgugcaaaaucccuguucaaauggcugucgauaugcagacacugacccccgugggcagacucaucacggccaacccugugauuacagaguccaccgaaaacagcaagaugaugcuggagcuugacccucccuuuggggauucuuacaucgucauuggcgugggagacaaaaagaucacacaccacuggcaucgcuccggcagcaccauugggaaggcuuucgaggccaccguucggggagcgaaaagaauggccgugcugggcgauacagcuugggacuucggguccgucggaggcguguuuaauucucucgggaagggcauccaccagaucuucggagccgcuuuuaaaagccuguucggcgggauguccugguuuucucaaauucugaucggaacgcuucucguuuggcugggccugaacaccaagaaugggagcauuucccucacaugucuggcccuuggaggcgugaugaucuuccugagcaccgccgucucugcugauguggggugcuccguugacuuuagcaaaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8921 - RNA, 2347 nt, Artificial Sequence
  DQ859059.1 prME-long mRNA Design 3 opt
gggagaaagcuuaccaugagaaucauuaacgcccggaaggagcgcaaaagacggggcgcugacaccagcaucgggauugugggacugcuccugacaacggccauggcggcugaaaucacccgcagaggcuccgccuacuauauguaccuugaucggucugacgccgggaaggcuauuagcuucgccacaacccugggagucaauaaaugccacguucagaucauggaucucggccauaugugugacgcuacaauguccuaugagugccccaugcuggaugaagggguggagcccgacgauguggacuguuggugcaacaccacaucuaccugggucguguacggaacgugucaccauaagaaaggcgaagcccgcagaagccggcgcgcgguuacccuuccgucccacucuacaagaaagcugcaaacccggagccagacauggcucgagucccgcgaguauaccaagcaucugaucaaaguggaaaauuggauuuuuagaaaccccggcuucacgcuggucgccguggcuaucgccuggcuccuggggagcucuacaucccagaagguuauuuaccuugugaugauccugcucauugcuccugccuauagcauccggugcauuggagucucuaaucgcgauuuuguggagggcauguccgggggaaccuggguggacgucguucuggaacacggcgggugugugacagugauggcgcaggauaaacccaccgucgacaucgagcuugugaccacaacgguuagcaacauggccgaggugagaucuuacugcuacgaagccuccaucagcgauauggcuuccgacucucgguguccuacccaaggagaggcuuaucuggacaagcagagcgauacacaguacgucugcaaaagaacccucguggaccgcggcuggggcaauggguguggacuguucggcaaggggucccugguuacaugcgccaaguuuaccugcagcaaaaagaugacgggaaaaucuauucagcccgaaaaccucgaguaucggaucaugcuguccgugcacggcagccaacauucugggaugauugucaaugaugaaaacagagccaagguggaggucacaccuaauagcccgcgcgcugaggcgacccuuggaggcuucggcucccuggggcucgacugugaaccccggaccggacuggauuuuucugaccuuuacuaucugacaaugaacaauaaacacuggcucgugcauaaggagugguuccacgauaucccucugcccuggcacgccggcgcugacaccgggacaccucauuggaacaauaaagaagcccugguugaguuuaaggaugcccacgcuaagagacagacgguggucgugcucggaagccaggaaggcgccguucauaccgcgcuggcuggggcccuugaggccgagauggacggcgcuaaaggacgccuguucuccggccaccucaagugccggcugaaaauggauaaacuuagacugaagggggugagcuacucucucuguacagccgcuuuuaccuucacaaagguccccgccgaaacccugcauggaacggugaccguggagguucaguaugcgggcacagacgggccgugcaaggucccugcccaaauggcuguggacaugcagacccugacacccgugggacgccucauuaccgccaacccugucaucacggaauccacagagaacagcaaaaugaugcuggaacuugauccucccuuuggcgacucuuacaucgugauugggguuggcgauaagaaaaucacccaccacuggcaucgguccggaagcacaauuggcaaggcuuucgaggccaccgugagaggggcgaaacgcauggccguccugggagacaccgcuugggauuucggcuccguugggggaguguuuaauucucucggcaaggggauccaccagauuuucggcgccgcuuuuaagagccuguucggaggcauguccugguuuucucaaauccugaucgggacacuucucguguggcugggacugaacacgaaaaauggcagcauuucccucaccugucuggcccuugggggagucaugaucuuccugagcacagccgugucugcugacguuggcugcuccguggauuuuagcaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8922 - RNA, 2365 nt, Artificial Sequence
  KX377335.1 prME-long mRNA Design 3 opt
gggagaaagcuuaccaugagaaucauuaacgcccggaaggagcgcaaaagacggggcgcugacaccagcaucgggauuaucggacugcuccugacaacggccauggcggcugaaauuacccgcagaggcuccgccuacuauauguaccuugaucggucugacgccgggaaggcuaucagcuucgccacaacccugggagugaauaaaugccacguccagaucauggaucucggccauaugugugacgcuacaauguccuaugagugccccaugcuggaugaagggguugagcccgacgauguggacuguuggugcaacaccacaucuaccuggguggucuacggaacgugucaccgcaagaaaggcgaagccagacggagccgcagagcggugacccuuccgucccauucuacacggaagcugcaaacccgcagccagacauggcucgaguccagagaguauaccaagcaccugauuaaaguugaaaauuggaucuuucggaaccccggcuucgcccugguggcugucgccauugcuuggcuccuggggagcucuacgucccagaaggugaucuaccuuguuaugauucugcucaucgccccugcguauagcauucgcugcaucggagugucuaauagagauuuugucgagggcauguccgggggaacauggguggacgugguccuggaacauggcggguguguuaccgugauggcccaggauaaacccacaguggacaucgagcuugucaccaccacagugagcaacauggcugagguucggucuuacugcuacgaagccuccauuagcgauauggcuuccgacucuagauguccuacgcaaggagaggccuaucuggacaagcagagcgauacccaguacgugugcaaacgcacacucgucgaccggggcuggggcaauggguguggacuguucggcaaggggucccuggugaccugcgccaaguuuacaugcagcaaaaagaugaccggaaaaucuauccagcccgaaaaccucgaguauagaauuaugcuguccguucacggcagccaacacucugggaugaucgugaaugauacgggauacgaaacagacgagaaccgcgcuaaggucgaggugaccccuaauagcccgcgggcggaagccacccuuggcggcuucgggucccugggacucgauugugagcccagaacaggccuggacuuuucugaucuuuauuaccugaccaugaacaauaaacauuggcucguccacaaggaaugguuccaugacauuccucugcccuggcacgcuggggccgauacaggaacgccucacuggaacaauaaagaggcccugguggaauuuaaggacgcucaugccaagcgccagaccguugugguccucggcagccaggagggggcggugcacacagcucuggccggcgcccuugaggcugaaauggauggagccaaaggcaagcuguucuccgggcaucucaaaugccggcugaagauggacaaacuuagacugaagggaguuagcuauucucucuguaccgcugccuuuacauucaccaaggugcccgcggagacgcugcacggcaccgucacaguggaagugcaguacgccgggaccgacggaccgugcaaaaucccuguucaaauggcugucgauaugcagacacugacccccgugggccgccucaucacggccaacccugugauuacagaguccaccgaaaacagcaagaugaugcuggagcuugacccucccuuuggggauucuuacaucgucauuggcgugggagacaaaaagaucacacaucacuggcaccgguccggcagcaccauugggaaggcuuucgaggccaccguuagaggagcgaaacgcauggccgugcugggcgauacagcuugggacuucggguccgucggaggcguguuuaauucucucgggaagggcauccaucagaucuucggagccgcuuuuaaaagccuguucggcgggauguccugguuuucucaaauucugaucggaacgcuucucguuuggcugggccugaacaccaagaaugggagcauuucccucacaugucuggcccuuggaggcgugaugaucuuccugagcaccgccgucucugcugauguggggugcuccguugacuuuagcaaaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8923 - RNA, 2365 nt, Artificial Sequence
  LC002520.1 prME-long mRNA Design 3 opt
gggagaaagcuuaccaugagaaucauuaacgcccggaaggagcgcaaaagacggggcgcugacaccagcaucgggauuaucggacugcuccugacaacggccauggcggcugaaauuacccgcagaggcuccgccuacuauauguaccuugaucggucugacgccgggaaggcuaucagcuucgccacaacccugggagugaauaaaugccacguccagaucauggaucucggccauaugugugacgcuacaauguccuaugagugccccaugcuggaugaagggguugagcccgacgauguggacuguuggugcaacaccacaucuaccuggguggucuacggaacgugucaccauaagaaaggcgaagcccgcagaagccggcgcgcggugacccuuccgucccacucuacaagaaagcugcaaacccggagccagacauggcucgagucccgcgaguauaccaagcaucugauuaaaguugaaaauuggaucuuuagaaaccccggcuucgcccugguggcugucgccauugcuuggcuccuggggagcucuacgucccagaaggugaucuaccuuguuaugauucugcucaucgccccugcguauagcauucggugcaucggagugucuaaucgcgauuuugucgagggcauguccgggggaacauggguggacgugguccuggaacacggcggguguguuaccgugauggcccaggauaaacccacaguggacaucgagcuugucaccaccacagugagcaacauggcugagguuagaucuuacugcuacgaagccuccauuagcgauauggcuuccgacucucgguguccuacgcaaggagaggccuaucuggacaagcagagcgauacccaguacgugugcaaaagaacacucgucgaccgcggcuggggcaauggguguggacuguucggcaaggggucccuggugaccugcgccaaguuuacaugcagcaaaaagaugaccggaaaaucuauccagcccgaaaaccucgaguaucggauuaugcuguccguucacggcagccaacauucugggaugacggugaaugauaucggauacgaaacagacgagaacagagcuaaggucgaggugaccccuaauagcccgcgcgcggaagccacccuuggcggcuucgggucccugggacucgauugugagccccggacaggccuggacuuuucugaucuuuauuaccugaccaugaacaauaaacacuggcucguccauaaggaaugguuccacgacauuccucugcccuggcacgcuggggccgauacaggaacgccucauuggaacaauaaagaggcccugguggaauuuaaggacgcucacgccaagagacagaccguugugguccucggcagccaggagggggcggugcauacagcucuggccggcgcccuugaggcugaaauggauggagccaaaggcaagcuguucuccgggcaccucaaaugccgccugaagauggacaaacuucggcugaagggaguuagcuauucucucuguaccgcugccuuuacauucaccaaggugcccgcggagacgcugcauggcaccgucacaguggaagugcaguacgccgggaccgacggaccgugcaaaaucccuguucaaauggcugucgauaugcagacacugacccccgugggcagacucaucacggccaacccugugauuacagaguccaccgaaaacagcaagaugaugcuggagcuugacccucccuuuggggauucuuacaucgucauuggcgugggagacaaaaagaucacacaccacuggcaucgcuccggcagcaccauugggaaggcuuucgaggccaccguucggggagcgaaaagaauggccgugcugggcgauacagcuugggacuucggguccgucggaggcguguuuaauucucucgggaagggcauccaccagaucuucggagccgcuuuuaaaagccuguucggcgggauguccugguuuucucaaauucugaucggaacgcuucucguuuggcugggccugaacaccaagaaugggagcauuucccucacaugucuggcccuuggaggcgugaugaucuuccugagcaccgccgucucugcugauguggggugcuccguugacuuuagcaaaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8924 - RNA, 2353 nt, Artificial Sequence
  KU963573.2 prME-long mRNA Design 3 opt
gggagaaagcuuaccaugagaaucauuaacgcccggaaggagcgcaaaagacggggcgcugacaccagcaucgggauuaucggacugcuccugacaacggccauggcggcugaaauuacccgcagaggcuccgccuacuauauguaccuugaucggucugacgccgggaaggcuaucagcuucgccacaacccugggagugaauaaaugccacguccagaucauggaucucggccauaugugugacgcuacaauguccuaugagugccccaugcuggaugaagggguugagcccgacgauguggacuguuggugcaacaccacaucuaccuggguggucuacggaacgugucaccauaagaaaggcgaagcccgcagaagccggcgcgcggugacccuuccgucccacucuacaagaaagcugcaaacccggagccagacauggcucgagucccgcgaguauaccaagcaucugauuaaaguugaaaauuggaucuuuagaaaccccggcuucgcccugguggcugucgccauugcuuggcuccuggggagcucuacgucccagaaggugaucuaccuuguuaugauucugcucaucgccccugcguauagcauucggugcaucggagugucuaaucgcgauuuugucgagggcauguccgggggaacauggguggacgugguccuggaacacggcggguguguuaccgugauggcccaggauaaacccacaguggacaucgagcuugucaccaccacagugagcaacauggcugagguuagaucuuacugcuacgaagccuccauuagcgauauggcuuccgacucucgguguccuacgcaaggagaggccuaucuggacaagcagagcgauacccaguacgugugcaaaagaacacucgucgaccgcggcuggggcaauggguguggacuguucggcaaggggucccuggugaccugcgccaaguuuacaugcagcaaaaagaugaccggaaaaucuauccagcccgaaaaccucgaguaucggauuaugcuguccguucacggcagccaacauucugggaugaucggauacgaaacggaugagaauagagcuaagguggaggucacaccuaacagcccgcgcgcggaagccacccuuggcggcuucgggucccugggacucgacugugagccccggaccggccuggauuuuucugaccuuuauuaccugacaaugaauaacaaacacuggcucgugcauaaggaaugguuccacgauauuccucugcccuggcacgcuggggccgacaccggaacaccucauuggaauaacaaagaggcccuggucgaauuuaaggaugcucacgccaagagacagacggugguugugcucggcagccaggagggggcgguccauaccgcucuggccggcgcccuugaggcugaaauggacggagccaaaggcaagcuguucuccgggcaccucaaaugccgccugaagauggauaaacuucggcugaagggagugagcuauucucucuguacagcugccuuuaccuucacaaagguucccgcggagacccugcauggcacggugaccgucgaagugcaguacgccgggacagacggaccgugcaaaaucccugugcaaauggcuguugacaugcagacccugacacccgucggcagacucaucaccgccaauccugugauuacggaguccacagaaaacagcaagaugaugcuggagcuugauccucccuuuggggacucuuacaucgugauuggcgucggagauaaaaagaucacccaccacuggcaucgcuccggcagcacaauugggaaggcuuucgaggccaccgugcggggagcgaaaagaauggccguucugggcgacaccgcuugggauuucggguccgugggaggcgucuuuaacucucucgggaagggcauccaccagaucuucggagccgcuuuuaaaagccuguucggcgggauguccugguuuucucaaauucugaucggaacacuucucguguggcugggccugaauacgaagaacgggagcauuucccucaccugucuggcccuuggaggcguuaugaucuuccugagcacagccgugucugcugacgucgggugcuccguggauuuuagcaaaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8925 - RNA, 2365 nt, Artificial Sequence
  KX694534.2 prME-long mRNA Design 3 opt
gggagaaagcuuaccaugagaaucauuaacgcccggaaggagaaaaagcgcagaggcgcugacaccagcguggggaucgucggacugcuccugacaacggccauggcggcugaaguuacccggcgcggcuccgccuacuauauguaccuugauagaaaugacgccggggaggcuauuucuuuccccacaacccugggaaugaacaaaugcuauauccagauuauggaucucggccacaugugugacgccacaaugagcuacgaaugcccuaugcuggaugaggggguggaaccggacgauguggacuguuggugcaauaccacauccaccugggucguguauggaacgugucaucacaagaaaggcgaggcucggcgcucuagacgggccguuacccuucccagccauuccacacgcaagcugcaaaccagaucucagacauggcucgagagccgggaauacaccaagcaccugauccgcguggagaacuggaucuuuagaaauccuggcuucgcgcuggccgcugccgcuauugccuggcuccugggguccagcacgucucagaaagucaucuaucuugugaugauucugcucaucgcgcccgccuacuccauucggugcaucggaguuagcaaccgcgauuuuguggaaggcaugucugggggaacaugggucgacguggugcuggagcauggcgggugugucaccguuauggcucaggauaagccuacaguggacauugagcuugugaccaccacagucuccaauauggccgaagugagaagcuacugcuaugaggcuucuaucuccgauauggccagcgacucccggugucccacgcaaggagaagccuaccuggacaaacagucugauacccaguauguuugcaagagaacacucguggaccgcggcuggggcaacggguguggacuguucggcaaagggagccuggugaccugcgcuaaguuugcgugcuccaagaaaaugacaggaaagagcauccagccugagaaucucgaauaccggauuaugcugucuguccacggcucccaacacagcgggaugaucguuaacgauaccggacaugagacggacgagaauagagccaaaguggaaauuacaccgaacucuccccgcgcugaggccacccuuggcggcuucgggagccugggacucgauugugaaccucggaccggccuggacuuuuccgaucuuuauuaccugacaaugaauaacaagcacuggcucguccauaaagagugguuccacgacaucccccugccuuggcacgccggggcugauaccggaacaccccauuggaauaacaaggaagcccugguggaguuuaaagacgcgcacgcuaagagacagacggucgugguucucggcucucaggagggggccgugcauaccgcccuggcuggcgcccuugaagcugagauggauggagccaagggccgccugagcuccgggcaccucaaaugccggcugaagauggacaaacuuagacugaagggagucagcuauucucucuguacagcggccuucaccuuuacaaaaauuccggcugaaacccugcauggcacggugaccguugaggugcaguacgccgggacagacggaccuugcaagguccccgcucaaauggccguggauaugcagacccugacaccugugggccgccucaucaccgcgaaccccguuaucacggaauccacagagaauagcaagaugaugcuggagcuugaucccccuuucggggacucuuacauugucaucggcgugggagagaaaaagauuacccaccacuggcaucgguccggcagcacaaucgggaaagccuuugaagcuaccgugagaggagccaagcgcauggcuguccugggcgacaccgccugggauuucggguccgugggaggcgcccucaacucucuggggcggggcauucaccagaucuucggagcugcguuuaaaagccuguucggcgggauguccugguuuucucaaauccuuauuggaacacuccugauguggcugggccucaauacgaagaacgggagcaucucccugaugugucuugcccugggaggcguucucauuuuccugagcaccgcugugucugccgacgucgggugcuccguggauuuuagcaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8926 - RNA, 2365 nt, Artificial Sequence
  KX447520.1 prME-long mRNA Design 3 opt
gggagaaagcuuaccaugagaaucauuaacgcccggaaggagaaaaagcgcagaggcgcugacgccagcguggggaucgucggacugcuccugaccacagcgauggcugccgaaguuacgcggcgcggcuccgccuacuauauguaccuugauagaaaugacgcuggggaggccauuucuuuccccaccacacugggaaugaacaaaugcuauauccagauuauggaucucggccacaugugugacgcuaccaugagcuacgaaugcccuaugcuggaugaggggguggaaccggacgauguggacuguuggugcaauacaaccuccacaugggucguguauggaaccugucaucacaagaaaggcgaggcccggcgcucuagacgggcgguuacgcuucccagccauuccacccgcaagcugcaaacaagaucucagaccuggcucgagagccgggaauacacaaagcaccugauccgcguggagaacuggaucuuuagaaauccuggcuucgcccuggcugccgcugccauugcguggcuccugggguccagcaccucucagaaagucaucuaucuugugaugauucugcucaucgcccccgcuuacuccauucggugcaucggaguuagcaaccgcgauuuuguggaaggcaugucugggggaacgugggucgacguggugcuggagcauggcgggugugucacaguuauggcccaggauaagccuaccguggacauugagcuugugacaaccaccgucuccaauauggcugaagugagaagcuacugcuaugaggccucuaucuccgauauggccagcgacucccggugucccacacaaggagaggcuuaccuggacaaacagucugauacgcaguauguuugcaagagaacccucguggaccgcggcuggggcaacggguguggacuguucggcaaagggagccuggucacaugcgcgaaguuugccugcuccaagaaaaugaccggaaagagcauccagccugaaaaucucgaauaccggauuaugcugucugugcacggcucccaacacagcgggaugaucguuaacgauacaggacaugagaccgacgagaauagagcuaaaguggaaauuacgccgaacucuccccgcgccgaggccacacuuggcggcuucgggagccugggacucgauugugaaccucggaccggccuggacuuuuccgaucuuuauuaccugaccaugaauaacaagcacuggcucguccauaaagagugguuccacgacaucccccugccuuggcacgcuggggccgauacaggaacaccccauuggaauaacaaggaagcgcugguggaguuuaaagacgcucacgccaagagacagaccgucgugguucucggcucucaggagggggccgugcauacggcucuggccggcgcucuugaagccgagauggauggagcgaagggccgccugagcuccgggcaccucaaaugccggcugaagauggacaaacuuagacugaagggagucagcuauucucucuguaccgccgcuuucacauuuaccaaaauuccggccgaaacacugcauggcaccgugacgguugaggugcaguacgcugggaccgacggaccuugcaagguccccgcccaaauggcgguggauaugcagacacugaccccugugggccgccucaucacagccaaccccguuaucaccgaauccacggagaauagcaagaugaugcuggagcuugaucccccuuucggggacucuuacauugucaucggcgugggagagaaaaagauuacacaccacuggcaucgguccggcagcaccaucgggaaggcuuuugaagccacagugagaggagcuaaacgcauggccguccugggcgacaccgccugggauuucggguccgugggaggcgcucucaacucucuggggaaaggcauucaccagaucuucggagcggccuuuaagagccuguucggcgggauguccugguuuucucaaauccuuauuggaacccuccugauguggcugggccucaauacaaagaacgggagcaucucccugaugugucuugcucugggaggcguucucauuuuccugagcacggccgugucugccgacgucgggugcuccguggauuuuagcaaaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8927 - RNA, 2365 nt, Artificial Sequence
  KX369547.1 prME-long mRNA Design 3 opt
gggagaaagcuuaccaugagaaucauuaacgcccggaaggagaaaaagcgcagaggcgcugacaccagcguggggaucgucggacugcuccugacaacggccauggcggcugaaguuacccggcgcggcuccgccuacuauauguaccuugauagaaaugacgccggggaggcuauuucuuuccccacaacccugggaaugaacaaaugcuauauccagauuauggaucucggccacaugugugacgccacaaugagcuacgaaugcccuaugcuggaugaggggguggaaccggacgauguggacuguuggugcaauaccacauccaccugggucguguauggaacgugucaucacaagaaaggcgaggcucggcgcucuagacgggccguuacccuucccagccauuccacacgcaagcugcaaaccagaucucagacauggcucgagagccgggaauacaccaagcaccugauccgcguggagaacuggaucuuuagaaauccuggccuggcgcucgccgcugccgcuauugccuggcugcuuggguccagcacgucucagaaagucaucuaucuggugaugauucuccugaucgcgcccgccuacuccauucggugcaucggaguuagcaaccgcgauuucguggaaggcaugucugggggaacaugggucgacguggugcuugagcauggcgggugugucaccguuauggcucaggauaagccuacaguggacauugagcuggugaccaccacagucuccaauauggccgaagugagaagcuacugcuaugaggcuucuaucuccgauauggccagcgacucccggugucccacgcaaggagaagccuaccucgacaaacagucugauacccaguauguuugcaagagaacacugguggaccgcggcuggggcaacggguguggacuguuuggcaaagggagccucgugaccugcgcuaaguucgcgugcuccaagaaaaugacaggaaagagcauccagccugagaaucuggaauaccggauuaugcuuucuguccacggcucccaacacagcgggaugaucguuaacgauaccggacaugagacggacgagaauagagccaaaguggaaauuacaccgaacucuccccgcgcugaggccacccugggcggcuuugggagccucggacuggauugugaaccucggaccggccuugacuucuccgaucuguauuaccucacaaugaauaacaagcacuggcugguccauaaagagugguuucacgacaucccccugccuuggcacgccggggcugauaccggaacaccccauuggaauaacaaggaagcccucguggaguucaaagacgcgcacgcuaagagacagacggucgugguucugggcucucaggagggggccgugcauaccgcccuugcuggcgcccuggaagcugagauggauggagccaagggccgccucagcuccgggcaccugaaaugccggcuuaagauggacaaacugagacucaagggagucagcuauucucuguguacagcggccuuuaccuucacaaaaauuccggcugaaacccugcauggcacggugaccguugaggugcaguacgccgggacagacggaccuugcaagguccccgcucaaauggccguggauaugcagacccucacaccugugggccgccugaucaccgcgaaccccguuaucacggaauccacagagaauagcaagaugaugcuugagcuggaucccccuuuuggggacucuuacauugucaucggcgugggagagaaaaagauuacccaccacuggcaucgguccggcagcacaaucgggaaagccuucgaagcuaccgugagaggagccaagcgcauggcuguccucggcgacaccgccugggauuuuggguccgugggaggcgcccugaacucucuggggaaaggcauucaccagaucuucggagcugcguucaagagccuuuuuggcgggauguccugguucucucaaauccucauuggaacacugcugauguggcucggccugaauacgaagaacgggagcaucucccuuaugugucuggcccucggaggcguucugauuuuucugagcaccgcugugucugccgacgucgggugcuccguggauuucagcaaaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8928 - RNA, 2365 nt, Artificial Sequence
  KX447515.1 prME-long mRNA Design 3 opt
gggagaaagcuuaccaugagaaucauuaacgcccggaaggagaaaaagcgcagaggcgcugacaccagcguggggaucgucggacugcuccugacaacggccauggcggcugaaguuacccggcgcggcuccgccuacuauauguaccuugauagaaaugacgccggggaggcuauuucuuuccccacaacccugggaaugaacaaaugcuauauccagauuauggaucucggccacaugugugacgccacaaugagcuacgaaugcccuaugcuggaugaggggguggaaccggacgauguggacuguuggugcaauaccacauccaccugggucguguauggaacgugucaucacaagaaaggcgaggcucggcgcucuagacgggccguuacccuucccagccauuccacacgcaagcugcaaaccagaucucagacauggcucgagagccgggaauacaccaagcaccugauccgcguggagaacuggaucuuuagaaauccuggcuucgcgcuggccgcugccgcuauugccuggcuccugggguccagcacgucucagaaagucaucuaucuugugaugauucugcucaucgcgcccgccuacuccauucggugcaucggaguuagcaaccgcgauuuuguggaaggcaugucugggggaacaugggucgacguggugcuggagcauggcgggugugucaccguuauggcucaggauaagccuacaguggacauugagcuugugaccaccacagucuccaauauggccgaagugagaagcuacugcuaugaggcuucuaucuccgauauggccagcgacucccggugucccacgcaaggagaagccuaccuggacaaacagucugauacccaguauguuugcaagagaacacucguggaccgcggcuggggcaacggguguggacuguucggcaaagggagccuggugaccugcgcuaaguuugcgugcuccaagaaaaugacaggaaagagcauccagccugagaaucucgaauaccggauuaugcugucuguccacggcucccaacacagcgggaugaucguuaacgauaccggacaugagacggacgagaauagagccaaaguggaaauuacaccgaacucuccccgcgcugaggccacccuuggcggcuucgggagccugggacucgauugugaaccucggaccggccuggacuuuuccgaucuuuauuaccugacaaugaauaacaagcacuggcucguccauaaagagugguuccacgacaucccccugccuuggcacgccggggcugauaccggaacaccccauuggaauaacaaggaagcccugguggaguuuaaagacgcgcacgcuaagagacagacggucgugguucucggcucucaggagggggccgugcauaccgcccuggcuggcgcccuugaagcugagauggauggagccaagggccgccugagcuccgggcaccucaaaugccggcugaagauggacaaacuuagacugaagggagucagcuauucucucuguacagcggccuucaccuuuacaaaaauuccggcugaaacccugcauggcacggugaccguugaggugcaguacgccgggacagacggaccuugcaagguccccgcucaaauggccguggauaugcagacccugacaccugugggccgccucaucaccgcgaaccccguuaucacggaauccacagagaauagcaagaugaugcuggagcuugaucccccuuucggggacucuuacauugucaucggcgugggagagaaaaagauuacccaccacugguaucgguccggcagcacaaucgggaaagccuuugaagcuaccgugagaggagccaagcgcauggcuguccugggcgacaccgccugggauuucggguccgugggaggcgcccucaacucucuggggaaaggcauucaucagaucuucggagcugcguuuaagagccuguucggcgggauguccugguuuucucaaauccuuauuggaacacuccugauguggcugggccucaauacgaagaacgggagcaucucccugaugugucuugcccugggaggcguucucauuuuccugagcaccgcugugucugccgacgucgggugcuccguggauuuuagcaaaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8929 - RNA, 2365 nt, Artificial Sequence
  KU501217.1 prME-long mRNA Design 3 opt
gggagaaagcuuaccaugagaaucauuaacgcccggaaggagaaaaagcgcagaggcgcugacaccagcguggggaucgucggacugcuccugacaacggccauggcggcugaaguuacccggcgcggcuccgccuacuauauguaccuugauagaaaugacgccggggaggcuauuucuuuccccacaacccugggaaugaacaaaugcuauauccagauuauggaucucggccacaugugugacgccacaaugagcuacgaaugcccuaugcuggaugaggggguggaaccggacgauguggacuguuggugcaauaccacauccaccugggucguguauggaacgugucaucacaagaaaggcgaggcucggcgcucuagacgggccguuacccuucccagccauuccacacgcaagcugcaaaccagaucucagacauggcucgagagccgggaauacaccaagcaccugauccgcguggagaacuggaucuuuagaaauccuggcuucgcgcuggccgcugccgcuauugccuggcuccugggguccagcacgucucagaaagucaucuaucuugugaugauucugcucaucgcgcccgccuacuccauucggugcaucggaguuagcaaccgcgauuuuguggaaggcaugucugggggaacaugggucgacguggugcuggagcauggcgggugugucaccguuauggcucaggauaagccuacaguggacauugagcuugugaccaccacagucuccaauauggccgaaaucagaagcuacugcuaugaggcuucuaucuccgauauggccagcgacucccggugucccacgcaaggagaagccuaccuggacaaacagucugauacccaguaugugugcaagagaacacucguugaccgcggcuggggcaacggguguggacuguucggcaaagggagccuggugaccugcgcuaaguuugcgugcuccaagaaaaugacaggaaagagcauucagccugagaaucucgaauaccggaucaugcugucuguccacggcucccaacacagcgggaugauugugaacgauaccggacaugagacggacgagaauagagccaaaguugaaaucacaccgaacucuccccgcgcugaggccacccuuggcggcuucgggagccugggacucgauugugaaccucggaccggccuggacuuuuccgaucuuuauuaccugacaaugaauaacaagcacuggcucgugcauaaagagugguuccacgacauuccccugccuuggcacgccggggcugauaccggaacaccccauuggaauaacaaggaagcccuggucgaguuuaaagacgcgcacgcuaagagacagacgguggucgugcucggcucucaggagggggccguucauaccgcccuggcuggcgcccuugaagcugagauggauggagccaagggccgccugagcuccgggcaccucaaaugccggcugaagauggacaaacuuagacugaagggagugagcuauucucucuguacagcggccuucaccuuuacaaaaaucccggcugaaacccugcauggcacggucaccguggagguucaguacgccgggacagacggaccuugcaaggugcccgcucaaauggccgucgauaugcagacccugacaccugugggccgccucaucaccgcgaaccccgugauuacggaauccacagagaauagcaagaugaugcuggagcuugaucccccuuucggggacucuuacaucguuauuggcgucggagagaaaaagaucacccaccacuggcaucgguccggcagcacaauugggaaagccuuugaagcuaccgugagaggagccaagcgcauggcugugcugggcgacaccgccugggauuucggguccgucggaggcgcccucaacucucuggggaaaggcauccaccagaucuucggagcugcguuuaagagccuguucggcgggauguccugguuuucucaaauucuuaucggaacacuccugauguggcugggccucaauacgaagaacgggagcauuucccugaugugucuugcccugggaggcgugcucaucuuccugagcaccgcuguuucugccgacguggggugcuccgucgauuuuagcaaaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8930 - RNA, 2365 nt, Artificial Sequence
  KU312314.1 prME-long mRNA Design 3 opt
gggagaaagcuuaccaugagaaucauuaacgcccggaaggagaaaaagcgcagaggcgcugacaccagcguggggaucgucggacugcuccugacaacggccauggcggcugaaguuacccggcgcggcuccgccuacuauauguaccuugauagaaaugacgccggggaggcuauuucuuuccccacaacccugggaaugaacaaaugcuauauccagauuauggaucucggccacaugugugacgccacaaugagcuacgaaugccccaugcuggaugaggggguggaaccggacgauguggacuguuggugcaauaccacauccaccugggucguguauggaacgugucaucacaagaaaggcgaggcucggcgcucuagacgggccguuacccuucccagccauuccacacgcaagcugcaaaccagaucucagacauggcucgagagccgggaauacaccaagcaccugauccgcguggagaacuggaucuuuagaaauccuggcuucgcgcuggccgcugccgcuauugccuggcuccugggguccagcacgucucagaaagucaucuaucuugugaugauucugcucaucgcgcccgccuacuccauucggugcaucggaguuagcaaccgcgauuuuguggaaggcaugucugggggaacaugggucgacguggugcuggagcauggcgggugugucaccguuauggcucaggauaagccuacaguggacauugagcuugugaccaccacagucuccaauauggccgaagugagaagcuacugcuaugaggcuucuaucuccgauauggccagcgacucccggugucccacgcaaggagaagccuaccuggacaaacagucugauacccaguauguuugcaagagaacacucguggaccgcggcuggggcaacggguguggacuguucggcaaagggagccuggugaccugcgcuaaguuugcgugcuccaagaaaaugacaggaaagagcauccagccugagaaucucgaauaccggauuaugcugucuguccacggcucccaacacagcgggaugaucguuaacgauaccggacaugagacggacgagaauagagccaaaguggaaauuacaccgaacucuccccgcgcugaggccacccuuggcggcuucgggagccugggacucgauugugaaccucggaccggccuggacuuuuccgaucuuuauuaccugacaaugaauaacaagcacuggcucguccauaaagagugguuccacgacaucccccugccuuggcacgccggggcugauaccggaacaccccauuggaauaacaaggaagcccugguggaguuuaaagacgcgcacgcuaagagacagacggucgugguucucggcucucaggagggggccgugcauaccgcccuggcuggcgcccuugaagcugagauggauggagccaagggccgccugagcuccgggcaccucaaaugccggcugaagauggacaaacuuagacugaagggagucagcuauucucucuguacagcggccuucaccuuuacaaaaauuccggcugaaacccugcauggcacggugaccguugaggugcaguacgccgggacagacggaccuugcaagguccuggcucaaauggccguggauaugcagacccucacacccgugggccgccugaucaccgcgaacccuguuaucacggaauccacagagaauagcaagaugaugcuugagcuggacccucccuucggggauucuuacauugucaucggcgugggagagaaaaagauuacccaccacuggcaucgguccggcagcacaaucgggaaagccuuugaagcuaccgugagaggagccaagcgcauggcuguccucggcgacaccgccugggauuucggguccgugggaggcgcccugaacucucuggggaaaggcauucaccagaucuucggagcugcguuuaagagccuuuucggcgggauguccugguuuucucaaauccucauuggaacacugcugauguggcucggccugaauacgaagaacgggagcaucucccuuaugugucuggcccucggaggcguucugauuuuccugagcaccgcugugucugccgacgucgggugcuccguggauuuuagcaaaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8931 - RNA, 2365 nt, Artificial Sequence
  KX446950.2 prME-long mRNA Design 3 opt
gggagaaagcuuaccaugagaaucauuaacgcccggaaggagaaaaagcgcagaggcgcugacaccagcguggggaucgucggacugcuccugacaacggccauggcggcugaaguuacccggcgcggcuccgccuacuauauguaccuugauagaaaugacgccggggaggcuauuucuuuccccacaacccugggaaugaacaaaugcuauauccagauuauggaucucggccacaugugugacgccacaaugagcuacgaaugcccuacccuggaugaggggguggaaccggacgauguggacuguuggugcaauacaaccuccacgugggucguguauggaaccugucaucacaagaaaggcgaggcucggcgcucuagacgggccguuacacuucccagccauuccacccgcaagcugcaaacaagaucucagaccuggcucgagagccgggaauacacgaagcaccugauccgcguggagaacuggaucuuuagaaauccuggcuucgcgcuggccgcugccgcuauugccuggcuccugggguccagcacaucucagaaagucaucuaucuugugaugauucugcucaucgcgcccgccuacuccauucggugcaucggaguuagcaaccgcgauuuuguggaaggcaugucugggggaaccugggucgacguggugcuggagcauggcgggugugucacaguuauggcucaggauaagccuaccguggacauugagcuugugaccacaacggucuccaauauggccgaagugagaagcuacugcuaugaggcuucuaucuccgauauggccagcgacucccggugucccacccaaggagaagccuaccuggacaaacagucugauacacaguauguuugcaagagaacccucguggaccgcggcuggggcaacggguguggacuguucggcaaagggagccuggucacaugcgcuaaguuugcgugcuccaagaaaaugaccggaaagagcauccagccugagaaucucgaauaccggauuaugcugucugugcacggcucccaacacagcgggaugaucguuaacgauacgggacaugagacagacgagaauagagccaaaguggaaauuaccccgaacucuccccgcgcugaggccacccuuggcggcuucgggagccugggacucgauugugaaccucggacaggccuggacuuuuccgaucuuuauuaccugaccaugaauaacaagcacuggcucguccauaaagagugguuccacgacaucccccugccuuggcacgccggggcugauacaggaacgccccauuggaauaacaaggaagcccugguggaguuuaaagacgcgcacgcuaagagacagaccgucgugguucucggcucucaggagggggccgugcauacagcccuggcuggcgcccuugaagcugagauggauggagccaagggccgccugagcuccgggcaccucaaaugccggcugaagauggacaaacuuagacugaagggagucagcuauucucucuguaccgcggccuucacauuuaccaaaauuccggcugaaacgcugcauggcaccgugacaguugaggugcaguacgccgggaccgacggaccuugcaagguccccgcucaaauggccguggauaugcagacacugaccccugugggccgccucaucacggcgaaccccguuaucacagaauccaccgagaauagcaagaugaugcuggagcuugaucccccuuucggggacucuuacauugucaucggcgugggagagaaaaagauuacacaccacuggcaucgguccggcagcaccaucgggaaagccuuugaagcuaccgugagaggagccaagcgcauggcuguccugggcgacacagccugggauuucggguccgugggaggcgcccucaacucucuggggaaaggcauucaccagaucuucggagcugcguuuaagagccuguucggcgggauguccugguuuucucaaauccuuauuggaacgcuccugauguggcugggccucaauaccaagaacgggagcaucucccugaugugucuugcccugggaggcguucucauuuuccugagcacagcugugucugccgacgucgggugcuccguggauuuuagcaaaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8932 - RNA, 2365 nt, Artificial Sequence
  KY003157.1 prME-long mRNA Design 3 opt
gggagaaagcuuaccaugagaaucauuaacgcccggaaggagaaaaagcgcagaggcgcugacaccagcguggggaucgucggacugcuccugacaacggccauggcggcugaaguuacccggcgcggcuccgccuacuauauguaccuugauagaaaugacgccggggaggcuauuucuuuccccacaacccugggaaugaacaaaugcuauauccagauuauggaucucggccacaugugugacgccacaaugagcuacgaaugcccuaugcuggaugaggggguggaaccggacgauguggacuguuggugcaauaccacauccaccugggucguguauggaacgugucaucacaagaaaggcgaggcucggcgcucuagacgggccguuacccuucccagccauuccacacgcaagcugcaaaccagaucucagacauggcucgagagccgggaauacaccaagcaccugauccgcguggagaacuggaucuuuagaaauccuggcuucgcgcuggccgcugccgcuauugccuggcuccugggguccagcacgucucagaaagucaucuaucuugugaugauucugcucaucgcgcccgccuacuccauucggugcaucggaguuagcaaccgcgauuuuguggaaggcaugucugggggaacaugggucgacguggugcuggagcauggcgggugugucaccguuauggcucaggauaagccuacaguggacauugagcuugugaccaccacagucuccaauauggccgaagugagaagcuacugcuaugaggcuucuaucuccgauauggccagcgacucccggugucccacgcaaggagaagccuaccuggacaaacagucugauacccaguauguuugcaagagaacacucguggaccgcggcuggggcaacggguguggacuguucggcaaagggagccuggugaccugcgcuaaguuugcgugcuccaagaaaaugacaggaaagagcauccagccugagaaucucgaauaccggauuaugcugucuguccacggcucccaacacagcgggaugaucguuaacgauaccggacaugagacggacgagaauagagccaaaguggaaauuacaccgaacucuccccgcgcugaggccacccuuggcggcuucgggagccugggacucgauugugaaccucggaccggccuggacuuuuccgaucuuuauuaccugacaaugaauaacaagcacuggcucguccauaaagagugguuccacgacaucccccugccuuggcacgccggggcugauaccggaacaccccauuggaauaacaaggaagcccugguggaguuuaaagacgcgcacgcuaagagacagacggucgugguucucggcucucaggagggggccgugcauaccgcccuggcuggcgcccuugaagcugagauggauggagccaagggccgccugagcuccgggcaccucaaaugccggcugaagauggacaaacuuagacugaagggagucagcuauucucucuguacagcggccuucaccuuuacaaaaauuccggcugaaacccugcauggcacggugaccguugaggugcaguacgccgggacagacggaccuugcaagguccccgcucaaauggccguggauaugcagacccugacaccugugggccgccucaucaccgcgaaccccguuaucacggaauccacagagaauagcaagaugaugcuggagcuugaucccccuuucggggacucuuacauugucaucggcgugggagagaaaaagauuacccaccacuggcaucgguccggcagcacaaucgggaaagccuuugaagcuaccgugagaggagccaagcgcauggcuguccugggcgacaccgccugggauuucggguccgugggaggcgcccucaacucucuggggaaaggcauucaccagaucuucggagcugcguuuaagagccuguucggcgggauguccugguuuucucaaauccuuauuggaacacuccugauguggcugggccucaauacgaagaacgggagcaucucccugaugugucuugcccugggaggcguucucauuuuccugagcaccguggucucugcugacguggggugcuccguugauuuuagcaaaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8933 - RNA, 2365 nt, Artificial Sequence
  KX811222.1 prME-long mRNA Design 3 opt
gggagaaagcuuaccaugagaaucauuaacgcccggaaggagaaaaagcgcagaggcgcugacaccagcguggggaucgucggacugcuccugacaacggccauggcggcugaaguuacccggcgcggcuccgccuacuauauguaccuugauagaaaugacgccggggaggcuauuucuuuccccacaacccugggaaugaacaaaugcuauauccagauuauggaucucggccacaugugugacgccacaaugagcuacgaaugcccuaugcuggaugaggggguggaaccggacgauguggacuguuggugcaauaccacauccgcuugggucguguauggaaccugucaucacaagaaaggcgaggcccggcgcucuagacgggcgguuacgcuucccagccauuccacccgcaagcugcaaacaagaccucagaccuggcucgagucucgggaauacacaaagcaccugauccgcguggagaacuggaucuuuagaaaucccggcuucgcccuggcugccgcugccauugcguggcuccuggggagcuccaccagccagaaagucaucuaucuugugaugauucugcucaucgccccugcuuacucuauucggugcaucggaguuuccaaccgcgauuuuguggaaggcaugagcgggggaacgugggucgacguggugcuggagcauggcgggugugucacaguuauggcccaggauaagcccaccguggacauugagcuugugacaaccaccgucucuaauauggcugaagugagauccuacugcuaugaggccagcaucucugauauggccuccgacagccgguguccuacacaaggagaggcuuaccuggacaaacaguccgauacgcaguauguuugcaagagaacccucguggaccgcggcuggggcaacggguguggacuguucggcaaagggucucuggucacaugcgcgaaguuugccugcagcaagaaaaugaccggaaaguccauccagccggagaaucucgaauaccggauuaugcugagcgugcacggcucucaacacuccgggaugaucguuaacgauacaggacaugagaccgacgagaauagagcuaaaguggaaauuacgcccaacagcccucgcgccgaggccacacuuggcggcuucgggucucugggacucgauugugaaccccggaccggccuggacuuuagcgaucuuuauuaccugaccaugaauaacaagcacuggcucguccauaaagagugguuccacgacaucccucugcccuggcacgcuggggccgauacaggaaccccgcauuggaauaacaaggaagcgcugguggaguuuaaagacgcucacgccaagagacagacagucgugguucucggcucccaggagggggccgugcauacggcucuggccggcgcucuugaagccgagauggauggagcgaagggccgccugucuagcgggcaccucaaaugccggcugaagauggacaaacuuagacugaagggagucuccuauagccucuguaccgccgcuuucacauuuaccaaaauuccugccgaaacacugcauggcaccgugacgguugaggugcaguacgcugggaccgacggacccugcaaggucccugcccaaauggcgguggauaugcagacacugacccccgugggccgccucaucacagccaaccccguuaucaccgaaucuacggaaaauuccaagaugaugcuggagcuugacccuccguucggggauagcuacauugucaucggcgugggagagaaaaagauuacacaccacuggcaucggucuggcuccaccaucgggaaggcuuuugaagccacagugagaggagcuaaacgcauggccguccugggcgacaccgccugggauuucgggagcgugggaggcgcucucaacucccuggggaaaggcauucaccagaucuucggagcggccuuuaagucucuguucggcgggaugagcugguuuucccaaauccuuauuggaacccuccugauguggcugggccucaauacaaagaacgggucuaucagccugaugugucuugcucugggaggcguucucauuuuccuguccacggccgugagcgccgacgucgggugcucuguggauuuuuccaaaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8934 - RNA, 2365 nt, Artificial Sequence
  KX447516.1 prME-long mRNA Design 3 opt
gggagaaagcuuaccaugagaaucauuaacgcccggaaggagaaaaagcgcagaggcgcugacaccagcguggggaucgucggacugcuccugacaacggccauggcggcugaaguuacccggcgcggcuccgccuacuauauguaccuugauagaaaugacgccggggaggcuauuucuuuccccacaacccugggaaugaacaaaugcuauauccagauuauggaucucggccacaugugugacgccacaaugagcuacgaaugcccuaugcuggaugaggggguggaaccggacgauguggacuguuggugcaauaccacauccaccugggucguguauggaacgugucaucacaagaaaggcgaggcucggcgcucuagacgggccguuacccuucccagccauuccacacgcaagcugcaaaccagaucucagacauggcucgagagccgggaauacaccaagcaccugauccgcguggagaacuggaucuuuagaaauccuggcuucgcgcuggccgcugccgcuauugccuggcuccugggguccagcacgucuaaaaaggucaucuaucuugugaugauucugcucaucgcgcccgccuacuccauucggugcaucggaguuagcaaccgcgauuuuguggaaggcaugucugggggaacaugggucgacguggugcuggagcauggcgggugugucaccguuauggcucaggauaaaccuacaguggacauugagcuugugaccaccacagucuccaauauggccgaagugagaagcuacugcuaugaggcuucuaucuccgauauggccagcgacucccggugucccacgcagggagaagccuaccuggacaagcaaucugauacccaguauguuugcaaaagaacacucguggaccgcggcuggggcaacggguguggacuguucggcaaggggagccuggugaccugcgcuaaguuugcgugcuccaaaaagaugacaggaaaaagcauccagccugagaaucucgaauaccggauuaugcugucuguccacggcucccagcacagcgggaugaucguuaacgauaccggacaugagacggacgagaauagagccaagguggaaauuacaccgaacucuccccgcgcugaggccacccuuggcggcuucgggagccugggacucgauugugaaccucggaccggccuggacuuuuccgaucuuuauuaccugacaaugaauaacaaacacuggcucguccauaaggagugguuccacgacaucccccugccuuggcacgccggggcugauaccggaacaccccauuggaauaacaaagaagcccugguggaguuuaaggacgcgcacgcuaagagacaaacggucgugguucucggcucucaggagggggccgugcauaccgcccuggcuggcgcccuugaagcugagauggauggagccaaaggccgccugagcuccgggcaccucaagugccggcugaaaauggacaaacuuagacugaagggagucagcuauucucucuguacagcggccuucaccuuuacaaagauuccggcugaaacccugcauggcacggugaccguugaggugcaguacgccgggacagacggaccuugcaagguccccgcucagauggccguggauaugcaaacccugacaccugugggccgccucaucaccgcgaaccccguuaucacggaauccacagagaauagcaaaaugaugcuggagcuugaucccccuuucggggacucuuacauugucaucggcgugggagaaaagaaaauuacccaccacuggcaucgguccggcagcacaaucgggaaggccuuugaggcuaccgugagaggagccaaacgcauggcuguccugggcgacaccgccugggauuucggguccgugggaggcgcccucaacucucuggggaagggcauucaccagaucuucggagcugcguuuaagagccuguucggcgggauguccugguuuucucagauccuuauuggaacacuccugauguggcugggccucaauacgaaaaacgggagcaucucccugaugugucuugcccugggaggcguucucauuuuccugagcaccgcugugucugccgacgucgggugcuccguggauuuuagcaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8935 - RNA, 2365 nt, Artificial Sequence
  KX520666.1 prME-long mRNA Design 3 opt
gggagaaagcuuaccaugagaaucauuaacgcccggaaggagaaaaagcgcagaggcgcugacaccagcguggggaucgucggacugcuccugacaacggccauggcggcugaaguuacccggcgcggcuccgccuacuauauguaccuugauagaaaugacgccggggaggcuauuucuuuccccacaacccugggaaugaacaaaugcuauauccagauuauggaucucggccacaugugugacgccacaaugagcuacgaaugcccuaugcuggaugaggggguggaaccggacgauguggacuguuggugcaauaccacauccaccugggucguguauggaacgugucaucacaagaaaggcgaggcucggcgcucuagacgggccguuacccuucccagccauuccacacgcaagcugcaaaccagaucucagacauggcucgagagccgggaauacaccaagcaccugauccgcguggagaacuggaucuuuagaaauccuggcuucgcgcuggccgcugccgcuauugccuggcuccugggguccagcacgcggcagaaagucaucuaucuugugaugauucugcucaucgcgcccgccuacucuauucgcugcaucggaguuuccaacagagauuuuguggaaggcaugagcgggggaacaugggucgacguggugcuggagcauggcgggugugucaccguuauggcucaggauaagccuacaguggacauugagcuugugaccaccacagucucuaauauggccgaagugcgguccuacugcuaugaggcuagcaucucugauauggccuccgacagcagaugucccacgcaaggagaagccuaccuggacaaacaguccgauacccaguauguuugcaagcgcacacucguggaccggggcuggggcaacggguguggacuguucggcaaagggucucuggugaccugcgcuaaguuugcgugcagcaagaaaaugacaggaaaguccauccagccugagaaucucgaauacagaauuaugcugagcguccacggcucucaacacuccgggaugaucguuaacgauaccggacaugagacggacgagaaucgcgccaaaguggaaauuacaccgaacagcccccgggcugaggccacccuuggcggcuucgggucucugggacucgauugugaaccuagaaccggccuggacuuuagcgaucuuuauuaccugacaaugaauaacaagcacuggcucguccauaaagagugguuccacgacaucccccugccuuggcacgccggggcugauaccggaacaccccauuggaauaacaaggaagcccugguggaguuuaaagacgcgcacgcuaagcgccagacggucgugguucucggcucccaggagggggccgugcauaccgcccuggcuggcgcccuugaagcugagauggauggagccaagggccggcugucuagcgggcaccucaaaugcagacugaagauggacaaacuucgccugaagggagucuccuauagccucuguacagcggccuucaccuuuacaaaaauuccggcugaaacccugcauggcacggugaccguugaggugcaguacgccgggacagacggaccuugcaagguccccgcucaaauggccguggauaugcagacccugacaccugugggccggcucaucaccgcgaaccccguuaucacggaaucuacagaaaauuccaagaugaugcuggagcuugaucccccuuucggggacagcuacauugucaucggcgugggagagaaaaagauuacccaccacuggcauagaucuggcuccacaaucgggaaagccuuugaggcuaccgugcgcggagccaagcggauggcuguccugggcgacaccgccugggauuucgggagcgugggaggcgcccucaacucccuggggaaaggcauucaccagaucuucggagcugcguuuaagucucuguucggcgggaugagcugguuuucccaaauccuuauuggaacacuccugauguggcugggccucaauacgaagaacgggucuaucagccugaugugucuugcccugggaggcguucucauuuuccuguccaccgcugugagcgccgacgucgggugcucuguggauuuuuccaaaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8936 - RNA, 2365 nt, Artificial Sequence
  KU729218.1 prME-long mRNA Design 3 opt
gggagaaagcuuaccaugagaaucauuaacgcccggaaggagaaaaagcgcagaagcgcugacaccuccgugggcaucgucgggcugcuccugacaacggccauggcggcugaaguuacccggcgcggaucugccuacuauauguaccuugauagaaaugacgccggcgaggcuauuagcuuccccacaacccuggggaugaacaaaugcuauauccagauuauggaucucggacacaugugugacgccacaauguccuacgaaugcccuaugcuggaugagggcguggaaccggacgauguggacuguuggugcaauaccacaucuaccugggucguguaugggacgugucaucacaagaaaggagaggcucggcgcagcagacgggccguuacccuucccucccauucuacacgcaagcugcaaaccagaagccagacauggcucgagucccgggaauacaccaagcaccugauccgcguggagaacuggaucuuuagaaauccuggcuucgcgcuggccgcugccgcuauugccuggcuccugggcagcucuacgucccagaaagucaucuaucuugugaugauucugcucaucgcgcccgccuacagcauucggugcaucgggguuucuaaccgcgauuuuguggaaggaauguccggcgggacaugggucgacguggugcuggagcauggaggcugugucaccguuauggcucaggauaagccuacaguggacauugagcuugugaccaccacagucagcaauauggccgaagugagaucuuacugcuaugaggcuuccaucagcgauauggccuccgacucucggugucccacgcaaggggaagccuaccuggacaaacagagcgauacccaguauguuugcaagagaacacucguggaccgcggauggggcaacggcugugggcuguucggaaaaggcucccuggugaccugcgcuaaguuugcgugcagcaagaaaaugacagggaagucuauccagccugagaaucucgaauaccggauuaugcuguccgugcacggaagccaacacucuggcaugaucguuaacgauaccgggcaugagacggacgagaauagagccaaaguggaaauuacaccgaacagcccccgcgcugaggccacccuuggaggcuucggcucccuggggcucgauugugaaccucggaccggacuggacuuuucugaucuuuauuaccugacaaugaauaacaagcacuggcucguccauaaagagugguuccacgacaucccccugccuuggcacgccggcgcugauaccgggacaccccauuggaauaacaaggaagcccugguggaguuuaaagacgcgcacgcuaagagacagacggucgugguucucggaagccaggagggcgccgugcauaccgcccuggcuggggcccuugaagcugagauggauggcgccaagggacgccuguccagcggccaccucaaaugccggcugaagauggacaaacuuagacugaagggggucucuuauucccucuguacagcggccuucaccuuuacaaaaauuccggcugaaacccugcauggaacggugaccguugaggugcaguacgccggcacagacgggccuugcaagguccccgcucaaauggccguggauacccagacacugaccccugugggacgccucaucacggcgaaccccguuaucacagaaagcaccgaaaauucuaagaugaugcuggagcuugaucccccuuucggcgacuccuacauugucaucggggugggcgagaaaaagauuacacaccacuggcaucggagcggauccaccaucggcaaagccuuugaggcuaccgugagaggggccaagcgcauggcuguccugggagacacagccugggauuucggcucugucgggggagcccucaacagccugggcaaagggauucaccagaucuucggcgcugcguuuaagucccuguucggaggcaugucuugguuuagccaaauccuuauugggacgcuccugauguggcugggacucaauaccaagaacggcuccaucagccugaugugucuugcccucgggggaguucugauuuuccugucuacagcuguguccgccgacgucggcugcagcguggauuuuucuaaaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8937 - RNA, 2365 nt, Artificial Sequence
  KU761561.1 prME-long mRNA Design 3 opt
gggagaaagcuuaccaugagaaucauuaacgcccggaaggagaaaaagcgcagaggcgcugacaccaauguggggaucgucggacugcuccugacaacggccauggcggcugaaguuacccggcgcggcagcgccuacuauauguaccuugauagaaacgacgccggggaggcuauuuccuuccccacaacccugggaaugaauaaaugcuauauccagauuauggaucucggccacaugugugacgccacaaugucuuacgaaugcccuaugcuggaugaggggguggaaccggacgauguggacuguuggugcaacaccacaagcaccugggucguguauggaacgugucaucacaagaaaggcgaggcucggcgcuccagacgggccguuacccuucccucucauagcacacgcaagcugcaaaccagaucccagacauggcucgagucucgggaauacaccaagcaccugauccgcguggagaauuggaucuuuagaaacccuggcuucgcgcuggccgcugccgcuauugccuggcuccuggggagcuccacgagccagaaagucaucuaucuugugaugauucugcucaucgcgcccgccuacucuauucggugcaucggaguuuccaaucgcgauuuuguggaaggcaugagcgggggaacaugggucgacguggugcuggagcauggcgggugugucaccguuauggcucaggauaagccuacaguggacauugagcuugugaccaccacagucucuaacauggccgaagugagauccuacugcuaugaggcuagcaucucugauauggccuccgacagccggugucccacgcaaggagaagccuaccuggacaaacaguccgauacccaguauguuugcaagagaacacucguggaccgcggcuggggcaauggguguggacuguucggcaaagggucucuggugaccugcgcuaaguuugcgugcagcaagaaaaugacaggaaaguccauccagccugagaaccucgaauaccggauuaugcugagcguccacggcucucaacacuccgggaugaucguuaaugauaccggacaugagacggacgagaacagagccaaaguggaaauuacaccgaauagcccccgcgcugaggccacccuuggcggcuucgggucucugggacucgauugugaaccucggaccggccuggacuuuagcgaucuuuauuaccugacaaugaacaauaagcacuggcucguccauaaagagugguuccacgacaucccccugccuuggcacgccggggcugauaccggaacaccccauuggaacaacaaggaagcccugguggaguuuaaagacgcgcacgcuaagagacagacggucgugguucucggcucccaggagggggccgugcauaccgcccuggcuggcgcccuugaagcugagauggauggagccaagggccgccugucuagcgggcaccucaaaugccggcugaagauggacaaacuuagacugaagggagucuccuauagccucuguacagcggccuucaccuuuacaaaaauuccggcugaaacccugcauggcacggugaccguugaggugcaguacgccgggacagacggaccuugcaagguccccgcucaaauggccguggauaugcagacccugacaccugugggccgccucaucaccgcgaaucccguuaucacggaaucuacagagaacuccaagaugaugcuggagcuugaucccccuuucggggacagcuacauugucaucggcgugggagagaaaaagauuacccaccacuggcaucggucuggcuccacaaucgggaaagccuuugaagcuaccgugagaggagcccgccggauggcuguccugggcgacaccgccugggauuucgggagcgugggaggcgcccucaauucccuggggaagggcauucaccagaucuucggagcugcguuuaaaucucuguucggcgggaugagcugguuuucccaaauccuuauuggaacacuccugauguggcugggccucaacacgaagaaugggucuaucagccugaugugucuugcccugggaggcguucucauuuuccuguccaccgcugugagcgccgacgucgggugcucuguggauuuuuccaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8938 - RNA, 2365 nt, Artificial Sequence
  KY317938.1 prME-long mRNA Design 3 opt
gggagaaagcuuaccaugagaaucauuaacgcccggaaggagaaaaagcgcagaggcgcugaaaccagcguggggaucgucggacugcuccugacaacggccauggcggcugagguuacccggcgcggcuccgccuacuauauguaccuugacagaaaugaugccggggaagcuauuucuuuccccacaacccugggaaugaacaaaugcuauauccagauuauggaccucggccacaugugugaugccacaaugagcuacgagugcccuaugcuggacgaagggguggagccggaugacguggauuguuggugcaauaccacauccaccugggucguguauggaacgugucaucacaagaaaggcgaggcucggcgcucuagacgggccguuacccuucccagccauuccacacgcaagcugcaaaccagaucucagacauggcucgaaagccgggaguacaccaagcaccugauccgcguggaaaacuggaucuuuagaaauccuggcuucgcgcuggccgcugccgcuauugccuggcuccugggguccagcacgucucagaaagucaucuaucuugugaugauucugcucaucgcgcccgccuacuccauucggugcaucggaguuagcaaccgcgacuuuguggagggcaugucugggggaacaugggucgauguggugcuggagcauggcgggugugucaccguuauggcucaggacaagccuacaguggauauugaacuugugaccaccacagucuccaauauggccgaggugagaagcuacugcuaugaggcuucuaucuccgacauggccagcgauucccggugucccacgcaaggagaagccuaccuggacaaacagucugacacccaguauguuugcaagagaacacucguggaucgcggcuggggcaacggguguggacuguucggcaaagggagccuggugaccugcgcuaaguuugcgugcuccaagaaaaugacaggaaagagcauccagccugaaaaucucgaguaccggauuaugcugucuguccacggcucccaacacagcgggaugaucguuaacgacaccggacaugagacggaugaaaauagagccaaaguggagauuacaccgaacucuccccgcgcugaagccacccuuggcggcuucgggagccugggacucgacugugagccucggaccggccuggauuuuuccgaccuuuauuaccugacaaugaauaacaagcacuggcucguccauaaagaaugguuccacgauaucccccugccuuggcacgccggggcugacaccggaacaccccauuggaauaacaaggaggcccugguggaguuuaaagaugcgcacgcuaagagacagacggucgugguucucggcucucaggaaggggccgugcauaccgcccuggcuggcgcccuugaggcugaaauggacggagccaagggccgccugagcuccgggcaccucaaaugccggcugaagauggauaaacuuagacugaagggagucagcuauucucucuguacagcggccuucaccuuuacaaaaauuccggcugagacccugcauggcacggugaccguugaagugcaguacgccgggacagacggaccuugcaagguccccgcucaaauggccguggacaugcagacccugacaccugugggccgccucaucaccgcgaaccccguuaucacggaguccacagagaauagcaagaugaugcuggaacuugaucccccuuucggggacucuuacauugucaucggcgugggagagaaaaagauuacccaccacuggcaucgguccggcagcacaaucgggaaagccuuugaagcuaccgugagaggagccaagcgcauggcuguccugggcgauaccgccugggacuucggguccgugggaggcgcccucaacucucuggggaaaggcauucaccagaucuucggagcugcguuuaagagccuguucggcgggauguccugguuuucucaaauccuuauuggaacacuccugauguggcugggccucaauacgaagaacgggagcaucucccugaugugucuugcccugggaggcguucucauuuuccugagcaccgcugugucugccgaugucgggugcuccguggacuuuagcaaaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8939 - RNA, 2365 nt, Artificial Sequence
  KY075939.1 prME-long mRNA Design 3 opt
gggagaaagcuuaccaugagaaucauuaacgcccggaaggagaaaaagcgcagaggcgcugacaccagcguggggaucgucggacugcuccugacaacggccauggcggcugaaguuacccggcgcggcuccgccuacuauauguaccuugauagaaaugacgccggggaggcuauuucuuuccccacaacccugggaaugaacaaaugcuauauccagauuauggaucucggccacaugugugacgccacaaugagcuacgaaugcccuaugcuggaugaggggguggaaccggacgauguggacuguuggugcaauaccacauccaccugggucguguauggaacgugucaucacaagaaaggcgaggcucggcgcucuagacgggccguuacccuucccagccauuccacacgcaagcugcaaaccagaucucagacauggcucgagagccgggaauacaccaagcaccugauccgcguggagaacuggaucuuuagaaauccuggcuucgcgcuggccgcugccgcuauugccuggcuccugggguccagcacgucucagaaagucaucuaucuugugaugauucugcucaucgcgcccgccuacucccugcggugcauuggaguuagcaaccgcgauuuuguggaaggcaugucugggggaacaugggucgacguggugcuugagcauggcgggugugucaccguuauggcucaggauaagccuacaguggacaucgagcuggugaccaccacagucuccaauauggccgaagugagaagcuacugcuaugaggcuucuauuuccgauauggccagcgacucccggugucccacgcaaggagaagccuaccucgacaaacagucugauacccaguauguuugcaagagaacacugguggaccgcggcuggggcaacggguguggacuguucggcaaagggagccucgugaccugcgcuaaguuugcgugcuccaagaaaaugacaggaaagagcauccagccugagaaucuggaauaccggaucaugcuuucuguccacggcucccaacacagcgggaugauuguuaacgauaccggacaugagacggacgagaauagagccaaaguggaaaucacaccgaacucuccccgcgcugaggccacccugggcggcuucgggagccucggacuggauugugaaccucggaccggccuugacuuuuccgaucuguauuaccucacaaugaauaacaagcacuggcugguccauaaagagugguuccacgacauuccccugccuuggcacgccggggcugauaccggaacaccccauuggaauaacaaggaagcccucguggaguuuaaagacgcgcacgcuaagagacagacggucgugguucugggcucucaggagggggccgugcauaccgcccuugcuggcgcccuggaagcugagauggauggagccaagggccgccucagcuccgggcaccugaaaugccggcuuaagauggacaaacugagacucaagggagucagcuauucucuguguacagcggccuucaccuuuacaaaaaucccggcugaaacccugcauggcacggugaccguugaggugcaguacgccgggacagacggaccuugcaagguccccgcucaaauggccguggauaugcagacccucacaccugugggccgccugauuaccgcgaaccccguuaucacggaauccacagagaauagcaagaugaugcuugagcuggaucccccuuucggggacucuuacaucgucauuggcgugggagagaaaaagaucacccaccacuggcaucgguccggcagcacaauugggaaagccuuugaagcuaccgugagaggagccaagcgcauggcuguccucggcgacaccgccugggauuucggguccgugggaggcgcccugaacucucuggggaaaggcauccaccagauuuucggagcugcguuuaagagccuuuucggcgggauguccugguuuucucaaauccucaucggaacacugcugauguggcucggccugaauacgaagaacgggagcauuucccuuaugugucuggcccucggaggcguucugaucuuccugagcaccgcugugucugccgacgucgggugcuccguggauuuuagcaaaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8940 - RNA, 2365 nt, Artificial Sequence
  KX806557.2 prME-long mRNA Design 3 opt
gggagaaagcuuaccaugagaaucauuaacgcccggaaggagaaaaagcgcagaggcgcugacaccaauguggggaucgucggacugcuccugacaacggccauggcggcugaaguuacccggcgcggcagcgccuacuauauguaccuugauagaaacgacgccggggaggcuauuuccuuccccacaacccugggaaugaauaaaugcuauauccagauuauggaucucggccacaugugugacgccacaaugucuuacgaaugcccuaugcuggaugaggggguggaaccggacgauguggacuguuggugcaacaccacaagcaccugggucguguauggaacgugucaucacaagaaaggcgaggcucggcgcuccagacgggccguuacccuucccucucauagcacacgcaagcugcaaaccagaucccagacauggcucgagucucgggaauacaccaagcaccugauccgcguggagaauuggauguuuagaaacccuggcuucgcgcuggccgcugccgcuaucgccuggcuccuggggagcuccacgagccagaaagucauuuaucuugugaugauccugcucauugcgcccgccuacucuauccggugcauuggaguuuccaaucgcgauuuuguggaaggcaugagcgggggaacaugggucgacguggugcuggagcauggcgggugugucaccguuauggcucaggauaagccuacaguggacaucgagcuugugaccaccacagucucuaacauggccgaagugagauccuacugcuaugaggcuagcauuucugauauggccuccgacagccggugucccacgcaaggagaagccuaccuggacaaacaguccgauacccaguauguuugcaagagaacacucguggaccgcggcuggggcaauggguguggacuguucggcaaagggucucuggugaccugcgcuaaguuugcgugcagcaagaaaaugacaggaaaguccauccagccugagaaccucgaauaccggaucaugcugagcguccacggcucucaacacuccgggaugauuguuaaugauaccggacaugagacggacgagaacagagccaaaguggaaaucacaccgaauagcccccgcgcugaggccacccuuggcggcuucgggucucugggacucgauugugaaccucggaccggccuggacuuuagcgaucuuuauuaccugacaaugaacaauaagcacuggcucguccauaaagagugguuccacgacauuccccugccuuggcacgccggggcugauaccggaacaccccauuggaacaacaaggaagcccugguggaguuuaaagacgcgcacgcuaagagacagacggucgugguucucggcucccaggagggggccgugcauaccgcccuggcuggcgcccuugaagcugagauggauggagccaagggccgccugucuagcgggcaccucaaaugccggcugaagauggacaaacuuagacugaagggagucuccuauagccucuguacagcggccuucaccuuuacaaaaaucccggcugaaacccugcauggcacggugaccguugaggugcaguacgccgggacagacggaccuugcaagguccccgcucaaauggccguggauaugcagacccugacaccugugggccgccucauuaccgcgaaucccguuaucacggaaucuacagagaacuccaagaugaugcuggagcuugaucccccuuucggggacagcuacaucgucauuggcgugggagagaaaaagaucacccaccacuggcaucggucuggcuccacaauugggaaagccuuugaagcuaccgugagaggagccaagcgcauggcuguccugggcgacaccgccugggauuucgggagcgugggaggcgcccucaauucccuggggaaaggcauccaccagauuuucggagcugcguuuaagucucuguucggcgggaugagcugguuuucccaaauccuuaucggaacacuccugauguggcugggccucaacacgaagaaugggucuauuagccugaugugucuugcccugggaggcguucucaucuuccuguccaccgcugugagcgccgacgucgggugcucuguggauuuuuccaaaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8941 - RNA, 2365 nt, Artificial Sequence
  KU870645.1 prME-long mRNA Design 3 opt
gggagaaagcuuaccaugagaaucauuaacgcccggaaggagaaaaagcgcagaggcgcugacaccagcguggggaucgucggacugcuccugacaacggccauggcggcugaaguuacccggcgcggcuccgccuacuauauguaccuugauagaaaugacgccggggaggcuauuucuuuccccacaacccugggaaugaacaaaugcuauauccagauuauggaucucggccacaugugugacgccacaaugagcuacgaaugcccuaugcuggaugaggggguggaaccggacgauguggacuguuggugcaauaccacauccaccugggucguguauggaacgugucaucacaagaaaggcgaggcucggcgcucuagacgggccguuacccuucccagccauuccacacgcaagcugcaaaccagaucucagacauggcucgagagccgggaauacaccaagcaccugauccgcguggagaacuggauccugagaaauccuggcuuugcgcucgccgcugccgcuauugccuggcugcuuggguccagcacgucucagaaagucaucuaucuggugaugauucuccugaucgcgcccgccuacuccauucggugcaucggaguuagcaaccgcgauuucguggaaggcaugucugggggaacaugggucgacguggugcuugagcauggcgggugugucaccguuauggcucaggauaagccuacaguggacauugagcuggugaccaccacagucuccaauauggccgaagugagaagcuacugcuaugaggcuucuaucuccgauauggccagcgacucccggugucccacgcaaggagaagccuaccucgacaaacagucugauacccaguauguuugcaagagaacacugguggaccgcggcuggggcaacggguguggacuguuuggcaaagggagccucgugaccugcgcuaaguucgcgugcuccaagaaaaugacaggaaagagcauccagccugagaaucuggaauaccggauuaugcuuucuguccacggcucccaacacagcgggaugaucguuaacgauaccggacaugagacggacgagaauagagccaaaguggaaauuacaccgaacucuccccgcgcugaggccacccugggcggcuuugggagccucggacuggauugugaaccucggaccggccuugacuucuccgaucuguauuaccucacaaugaauaacaagcacuggcugguccauaaagagugguuucacgacaucccccugccuuggcacgccggggcugauaccggaacaccccauuggaauaacaaggaagcccucguggaguucaaagacgcgcacgcuaagagacagacggucgugguucugggcucucaggagggggccgugcauaccgcccuugcuggcgcccuggaagcugagauggauggagccaagggccgccucagcuccgggcaccugaaaugccggcuuaagauggacaaacugagacucaagggagucagcuauucucuguguacagcggccuuuaccuucacaaaaauuccggcugaaacccugcauggcacggugaccguugaggugcaguacgccgggacagacggaccuugcaagguccccgcucaaauggccguggauaugcagacccucacaccugugggccgccugaucaccgcgaaccccguuaucacggaauccacagagaauagcaagaugaugcuugagcuggaucccccuuuuggggacucuuacauugucaucggcauuggagagaaaaagaucacccaccacuggcaucgguccggcagcacaauugggaaagccuucgaagcuaccgugagaggagccaagcgcauggcugugcucggcgacaccgccugggauuuuggguccgucggaggcgcccugaacucucuggggaaaggcauccaccagaucuucggagcugcguucaagagccuuuuuggcgggauguccugguucucucaaauucucaucggaacacugcugauguggcucggccugaauacgaagaacgggagcauuucccuuaugugucuggcccucggaggcgugcugaucuuucugagcaccgcuguuucugccgacguggggugcuccgucgauuucagcaaaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8942 - RNA, 2365 nt, Artificial Sequence
  KU729217.2 prME-long mRNA Design 3 opt
gggagaaagcuuaccaugagaaucauuaacgcccggaaggagaaaaagcgcagaggcgcugacaccagcguggggaucgucggacugcuccugacaacggccauggcggcugaaguuacccggcgcggcuccgccuacuauauguaccuugauagaaaugacgccggggaggcuauuucuuuccccacaacccugggaaugaacaaaugcuauauccagauuauggaucucggccacaugugugacgccacaaugagcuacgaaugcccuaugcuggaugaggggguggaaccggacgauguggacuguuggugcaauaccacauccaccugggucguguauggaacgugucaucacaagaaaggcgaggcucggcgcucuagacgggccguuacccuucccagccauuccacacgcaagcugcaaaccagaucucagacauggcucgagagccgggaauacaccaagcaccugauccgcguggagaacuggaucuuuagaaauccuggcuucgcgcuggccgcugccgcuauugccuggcuccugggguccagcacgucucagaaagucaucuaucuugugaugauucugcucaucgcgcccgccuacuccauucggugcaucggaguuagcaaccgcgauuuuguggaaggcaugucugggggaacaugggucgacguggugcuggagcauggcgggugugucaccguuauggcucaggauaagccuacaguggacauugagcuuguguccaccaccgucagcaauauggccgaagugagaucuuacugcuaugaggcuacaaucuccgauaucgccagcgacucccggugucccacgcaaggagaagccuaccuggacaaacagucugauacccaguauguuugcaagagaacacucguggaccgcggcuggggcaacggguguggacuguucggcaaagggagccuggugaccugcgcuaaguuugcgugcuccaagaaaaugacaggaaagagcauucagccugagaaucucgaauaccggaucaugcugucuguccacggcucccaacacagcgggaugauuguuaacgauaccggacaugagacggacgagaauagagccaaaguggaaaucacaccgaacucuccccgcgcugaggccacccuuggcggcuucgggagccugggacucgauugugaaccucggaccggccuggacuuuuccgaucuuuauuaccugacaaugaauaacaagcacuggcucguccauaaagagugguuccacgacauuccccugccuuggcacgccggggcugauaccggaacaccccauuggaauaacaaggaagcccugguggaguuuaaagacgcgcacgcuaagagacagacggccgucgugcucggcucucaggagggggccguucauaccgcucuggccggcgcucuugaagccgagauggauggagcgaagggccgccugagcuccgggcaccucaaaugccggcugaagauggacaaacuuagacugaagggagugagcuauucucucuguacagccgcuuucaccuuuacaaaaaucccggccgaaacccugcauggcacggucaccguggagguucaguacgcugggacagacggaccuugcaaggugcccgcccaaauggcggucgauaugcagacccugacaccugugggccgccucaucaccgccaaccccgugauuacggaauccacagagaauagcaagaugaugcuggagcuugaucccccuuucggggacucuuacaucguuauuggcgucggagagaaaaagaucacccaccacuggcaucgguccggcagcacaauugggaaggcuuuugaagccaccgugagaggagcuaaacgcauggccgugcugggcgacaccgccugggauuucggguccgucggaggcgcucucaacucucuggggaaaggcauccaccagaucuucggagcggccuuuaagagccuguucggcgggauguccugguuuucucaaauucuuaucggaacacuccugauguggcugggccucaauacgaagaacgggagcauuucccugaugugucuugcucugggaggcgugcucaucuuccugagcaccgccguuucugccgacguggggugcuccgucgauuuuagcaaaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8943 - RNA, 2365 nt, Artificial Sequence
  KU497555.1 prME-long mRNA Design 3 opt
gggagaaagcuuaccaugagaaucauuaacgcccggaaggagaaaaagcgcagaggcgcugacaccagcguggggaucgucggacugcuccugacaacggccauggcggcugaaguuacccggcgcggcuccgccuacuauauguaccuugauagaaaugacgccggggaggcuauuucuuuccccacaacccugggaaugaacaaaugcuauauccagauuauggaucucggccacaugugugacgccacaaugagcuacgaaugcccuaugcuggaugaggggguggaaccggacgauguggacuguuggugcaauaccacauccaccugggucguguauggaacgugucaucacaagaaaggcgaggcucggcgcucuagacgggccguuacccuucccagccauuccacacgcaagcugcaaaccagaucucagacauggcucgagagccgggaauacaccaagcaccugauccgcguggagaacuggaucuuuagaaauccuggcuucgcgcuggccgcugccgcuauugccuggcuccugggguccagcacgucucagaaagucaucuaucuugugaugauucugcucaucgcgcccgccuacuccauucggugcaucggaguuagcaaccgcgauuuuguggaaggcaugucugggggaacaugggucgacguggugcuggagcauggcgggugugucaccguuauggcucaggauaagccuacaguggacauugagcuugugaccaccacagucuccaauauggccgaagugagaagcuacugcuaugaggcuucuaucuccgauauggccagcgacucccggugucccacgcaaggagaagccuaccuggacaaacagucugauacccaguauguuugcaagagaacacucguggaccgcggcuggggcaacggguguggacuguucggcaaagggagccuggugaccugcgcuaaguuugcgugcuccaagaaaaugacaggaaagagcauccagccugagaaucucgaauaccggauuaugcugucuguccacggcucccaacacagcgggaugaucguuaacgauaccggacaugagacggacgagaauagagccaaaguggaaauuacaccgaacucuccccgcgcugaggccacccuuggcggcuucgggagccugggacucgauugugaaccucggaccggccuggacuuuuccgaucuuuauuaccugacaaugaauaacaagcacuggcucguccauaaagagugguuccacgacaucccccugccuuggcacgccggggcugauaccggaacaccccauuggaauaacaaggaagcccugguggaguuuaaagacgcgcacgcuaagagacagacggucgugguucucggcacccaggagggggccgugcauacagcccuggcuggcgcccuugaagcugagauggauggagccaagggccgccugucuagcgggcaccucaaaugccggcugaagauggacaaacuuagacugaagggagucuccuauagccucuguaccgcggccuucacauuuaccaaaauuccggcugaaacgcugcauggcaccgugacaguugaggugcaguacgccgggaccgacggaccuugcaagguccccgcucaaauggccguggauaugcagacacugaccccugugggccgccucaucacggcgaaccccguuaucacagaaucuaccgaaaauuccaagaugaugcuggagcuugaucccccuuucggggacagcuacauugucaucggcgugggagagaaaaagauuacacaccacuggcaucggucuggcuccaccaucgggaaagccuuugaggcuaccgugagaggagccaagcgcauggcuguccugggcgacacagccugggauuucgggagcgugggaggcgcccucaacucccuggggaaaggcauucaccagaucuucggagcugcguuuaagucucuguucggcgggaugagcugguuuucccaaauccuuauuggaacgcuccugauguggcugggccucaauaccaagaacgggucuaucagccugaugugucuugcccugggaggcguucucauuuuccuguccacagcugugagcgccgacgucgggugcucuguggauuuuuccaaaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8944 - RNA, 2365 nt, Artificial Sequence
  KX087101.3 prME-long mRNA Design 3 opt
gggagaaagcuuaccaugagaaucauuaacgcccggaaggagaaaaagcgcagaggcgcugacaccagcguggggaucgucggacugcuccugacaacggccauggcggcugaaguuacccggcgcggcuccgccuacuauauguaccuugauagaaaugacgccggggaggcuauuucuuuccccacaacccugggaaugaacaaaugcuauauccagauuauggaucucggccacaugugugacgccacaaugagcuacgaaugcccuaugcuggaugaggggguggaaccggacgauguggacuguuggugcaauaccacauccaccugggucguguauggaacgugucaucacaagaaaggcgaggcucggcgcucuagacgggccguuacccuucccagccauuccacacgcaagcugcaaaccagaucucagacauggcucgagagccgggaauacaccaagcaccugauccgcguggagaacuggaucuuuagaaauccuggcuucgcgcuggccgcugccgcuauugccuggcuccugggguccagcacgucucagaaagucaucuaucuugugaugauucugcucaucgcgcccgccuacuccauucggugcaucggaguuagcaaccgcgauuuuguggaaggcaugucugggggaacaugggucgacguggugcuggagcauggcgggugugucaccguuauggcucaggauaagccuacaguggacauugagcuugugaccaccacagucuccaauauggccgaagugagaagcuacugcuaugaggcuucuaucuccgauauggccagcgacucccggugucccacgcaaggagaagccuaccuggacaaacagucugauacccaguauguuugcaagagaacacucguggaccgcggcuggggcaacggguguggacuguucggcaaagggagccuggugaccugcgcuaaguuugcgugcuccaagaaaaugacaggaaagagcauccagccugagaaucucgaauaccggauuaugcugucuguccacggcucccaacacagcgggaugaucguuaacgauaccggacaugagacggacgagaauagagccaaaguggaaauuacaccgaacucuccccgcgcugaggccacccuuggcggcuucgggagccugggacucgauugugaaccucggaccggccuggacuuuuccgaucuuuauuaccugacaaugaauaacaagcacuggcucguccauaaagagugguuccacgacaucccccugccuuggcacgccggggcugauaccggaacaccccauuggaauaacaaggaagcccugguggaguuuaaagacgcgcacgcuaagagacagacggucgugguucucggcucucaggagggggccgugcauaccgcccuggcuggcgcccuugaagcugagauggauggagccaagggccgccugagcuccgggcaccucaaaugccggcugaagauggacaaacuuagacugaagggagucagcuauucucucuguacagcggccuucaccuuuacaaaaauuccggcugaaacccugcauggcacggugaccguugagcugcaguacgccgggacagacggaccuugcaaggugcccgcucaaauggccgucgauaugcagacccucacaccugugggccgccugaucaccgcgaaccccgugaucacggaauccacagagaauagcaagaugaugcuugagcuggaucccccuuucggggacucuuacauuguuaucggcgucggagagaaaaagauuacccaccacuggcaucgguccggcagcacaaucgggaaagccuuugaagcuaccgugagaggagccaagcgcauggcugugcucggcgacaccgccugggauuucggguccgucggaggcgcccugaacucucuggggaaaggcauucaccagaucuucggagcugcguuuaagagccuuuucggcgggauguccugguuuucucaaauccucauuggaacacugcugauguggcucggccugaauacgaagaacgggagcaucucccuuaugugucuggcccucggaggcgugcugauuuuccugagcaccgcuguuucugccgacguggggugcuccgucgauuuuagcaaaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8945 - RNA, 2365 nt, Artificial Sequence
  KY075932.1 prME-long mRNA Design 3 opt
gggagaaagcuuaccaugagaaucauuaacgcccggaaggagaaaaagcgcagaggcgcugaaaccagcguggggaucgucggacugcuccugacaacggccauggcggcugagguuacccggcgcggcuccgccuacuauauguaccuugacagaaaugaugccggggaagcuauuucuuuccccacaacccugggaaugaacaaaugcuauauccagauuauggaccucggccacaugugugaugccacaaugagcuacgagugcccuaugcuggacgaagggguggagccggaugacguggauuguuggugcaauaccacauccaccugggucguguauggaacgugucaucacaagaaaggcgaggcucggcgcucuagacgggccguuacccuucccagccauuccacacgcaagcugcaaaccagaucucagacauggcucgaaagccgggaguacaccaagcaccugauccgcaucgaaaacuggauuuuuagaaauccuggcuucgcgcuggccgcugccgcuaucgccuggcuccugggguccagcacgucucagaaagugauuuaucuugucaugauccugcucauugcgcccgccuacuccauccggugcauuggagugagcaaccgcgacuuuguugagggcaugucugggggaacauggguggaugucgugcuggagcauggcgggugugugaccgucauggcucaggacaagccuacaguugauaucgaacuugugaccaccacaguguccaauauggccgaggucagaagcuacugcuaugaggcuucuaucuccgacauggccagcgauucccggugucccacgcaaggagaagccuaccuggacaaacagucugacacccaguaugugugcaagagaacacucguugaucgcggcuggggcaacggguguggacuguucggcaaagggagccuggugaccugcgcuaaguuugcgugcuccaagaaaaugacaggaaagagcauucagccugaaaaucucgaguaccggaucaugcugucuguccacggcucccaacacagcgggaugauugugaacgacaccggacaugagacggaugaaaauagagccaaaguugagaucacaccgaacucuccccgcgcugaagccacccuuggcggcuucgggagccugggacucgacugugagccucggaccggccuggauuuuuccgaccuuuauuaccugacaaugaauaacaagcacuggcucgugcauaaagaaugguuccacgauauuccccugccuuggcacgccggggcugacaccggaacaccccauuggaauaacaaggaggcccuggucgaguuuaaagaugcgcacgcuaagagacagacgguggucgugcucggcucucaggaaggggccguucauaccgcccuggcuggcgcccuugaggcugaaauggacggagccaagggccgccugagcuccgggcaccucaaaugccggcugaagauggauaaacuuagacugaagggagugagcuauucucucuguacagcggccuucaccuuuacaaaaaucccggcugagacccugcauggcacggucaccguggaaguucaguacgccgggacagacggaccuugcaaggugcccgcucaaauggccgucgacaugcagacccugacaccugugggccgccucaucaccgcgaaccccgugauuacggaguccacagagaauagcaagaugaugcuggaacuugaucccccuuucggggacucuuacaucguuauuggcgucggagagaaaaagaucacccaccacuggcaucgguccggcagcacaauugggaaagccuuugaagcuaccgugagaggagccaagcgcauggcugugcugggcgauaccgccugggacuucggguccgucggaggcgcccucaacucucuggggaaaggcauccaccagaucuucggagcugcguuuaagagccuguucggcgggauguccugguuuucucaaauucuuaucggaacacuccugauguggcugggccucaauacgaagaacgggagcauuucccugaugugucuugcccugggaggcgugcucaucuuccugagcaccgcuguuucugccgauguggggugcuccgucgacuuuagcaaaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8946 - RNA, 2365 nt, Artificial Sequence
  KY014317.1 prME-long mRNA Design 3 opt
gggagaaagcuuaccaugagaaucauuaacgcccggaaggagaaaaagcgcagaggcgcugacaccagcguggggaucgucggacugcuccugacaacggccauggcggcugaaguuacccggcgcggcuccgccuacuauauguaccuugauagaaaugacgccggggaggcuauuucuuuccccacaacccugggaaugaacaaaugcuauauccagauuauggaucucggccacaugugugacgccacaaugagcuacgaaugcccuaugcuggaugaggggguggaaccggacgauguggacuguuggugcaauaccacauccaccugggucguguauggaacgugucaucacaagaaaggcgaggcucggcgcucuagacgggccguuacccuucccagccauuccacacgcaagcugcaaaccagaucucagacauggcucgagagccgggaauacaccaagcaccugauccgcguggagaacuggaucuuuagaaauccuggcuucgcgcuggccgcugccgcuauugccuggcuccugggguccagcacgucucagaaagucaucuaucuugugaugauucugcucaucgcgcccgccuacuccauucggugcaucggaguuagcaaccgcgauuuuguggaaggcaugucugggggaacaugggucgacguggugcuggagcauggcgggugugucaccguuauggcucaggauaagccuacaguggacauugagcuugugaccaccacagucuccaauauggccgaagugagaagcuacugcuaugaggcuucuaucuccgauauggccagcgacucccggugucccacgcaaggagaagccuaccuggacaaacagucugauacccaguauguuugcaagagaacacucguggaccgcggcuggggcaacggguguggacuguucggcaaagggagccuggugaccugcgcuaaguuugcgugcuccaagaaaaugacaggaaagagcauccagccugagaaucucgaauaccggauuaugcugucuguccacggcucccaacacagcgggaugaucguuaacgauaccggacaugagacggacgagaauagagccaaaguggaaauuacaccgaacucuccccgcgcugaggccacccuuggcggcuucgggagccugggacucgauugugaaccucggaccggccuggacuuuuccgaucuuuauuaccugacaaugaauaacaagcacuggcucguccauaaagagugguuccacgacaucccccugccuuggcacgccggggcugauaccggaacaccccauuggaauaacaaggaagcccugguggaguuuaaagacgcgcacgcuaagagacagacggucgugguucucggcucucaggagggggccgugcauaccgcccuggcuggcgcccuugaagcugagauggauggagccaagggccgccugagcuccgggcaccucaaaugccggcugaagauggacaaacuuagacugaagggagucagcuauucucucuguacagcggccuucaccuuuacaaaaauuccggcugaaacccugcauggcacggugaccguugaggugcaguacgccgggacagacggaccuugcaagguccccgcucaaauggccguggauaugcagacccugacaccugugggccgccucaucaccgcgaaccccguuaucacggaauccauugagaauagcaagaugaugcuggagcuugaucccccuuucggggacucuuacaucgucauuggcgugggagagaaaaagaucacacaccacuggcaucgguccggcagcaccauugggaaagccuuugaagcuacagugagaggagccaagcgcauggcuguccugggcgacaccgccugggauuucggguccgugggaggcgcccucaacucucuggggaaaggcauccaccagaucuucggagcugcguuuaagagccuguucggcgggauguccugguuuucucaaauucuuaucggaacccuccugauguggcugggccucaauacaaagaacgggagcauuucccugaugugucuugcccugggaggcguucucaucuuccugagcacggcugugucugccgacgucgggugcuccguggauuuuagcaaaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8947 - RNA, 2365 nt, Artificial Sequence
  KU758876.1 prME-long mRNA Design 3 opt
gggagaaagcuuaccaugagaaucauuaacgcccggaaggagaaaaagcgcagaggcgcugacaccagcguggggaucgucggacugcuccugacaacggccauggcggcugaaguuacccggcgcggcuccgccuacuauauguaccuugauagaaaugacgccggggaggcuauuucuuuccccacaacccugggaaugaacaaaugcuauauccagauuauggaucucggccacaugugugacgccacaaugagcuacgaaugcccuaugcuggaugaggggguggaaccggacgauguggacuguuggugcaauaccacauccaccugggucguguauggaacgugucaucacaagaaaggcgaggcucggcgcucuagacgggccguuacccuucccagccauuccacacgcaagcugcaaaccagaucucagacauggcucgagagccgggaauacaccaagcaccugauccgcguggagaacuggaucuuuagaaauccuggcuucgcgcuggccgcugccgcuauugccuggcuccugggguccagcacgucucagaaagucaucuaucuugugaugauucugcucaucgcgcccgccuacuccauucggugcaucggaguuagcaaccgcgauuuuguggaaggcaugucugggggaacaugggucgacguggugcuggagcauggcgggugugucaccguuauggcucaggauaagccuacaguggacauugagcuugugaccaccacagucuccaauauggccgaagugagaagcuacugcuaugaggcuucuaucuccgauauggccagcgacucccggugucccacgcaaggagaagccuaccuggacaaacagucugauacccaguauguuugcaagagaacacucguggaccgcggcuggggcaacggguguggacuguucggcaaagggagccuggugaccugcgcuaaguuugcgugcuccaagaaaaugacaggaaagagcauccagccugagaaucucgaauaccggauuaugcugucuguccacggcucccaacacagcgggaugaucguuaacgauaccggacaugagacggacgagaauagagccaaaguggaaauuacaccgaacucuccccgcgcugaggccacccuuggcggcuucgggagccugggacucgauugugaaccucggaccggccuggacuuuuccgaucuuuauuaccugacaaugaauaacaagcacuggcucguccauaaagagugguuccacgacaucccccugccuuggcacgccggggcugauaccggaacaccccauuggaauaacaaggaagcccugguggaguuuaaagacgcgcacgcuaagagacagacggucgugguucucggcucucaggagggggccgugcauaccgcccuggcuggcgcccuugaagcugagauggauggagucaagggccgccugagcuccgggcaccucaaaugccggcugaagauggacaaacuuagacugaagggagugagcuauucucucuguacagccgcguucaccuuuacaaaaauuccggccgaaacccugcauggcacgguuaccguggagguccaguacgcugggacagacggaccuugcaaggugcccgcccaaauggcuguggauaugcagacccugacaccuguuggccgccucaucaccgccaaccccgucaucacggaauccacagagaauagcaagaugaugcuggagcuugaucccccuuucggggacucuuacauugugaucggcgugggagagaaaaagauuacccaccacuggcaucgguccggcagcacaaucgggaaagcguuugaagccaccgucagaggagcuaagcgcauggccgugcugggcgacaccgcuugggauuucggguccguuggaggcgcccucaacucucuggggaaaggcauucaccagaucuucggagccgcuuuuaagagccuguucggcgggauguccugguuuucucaaauccuuauuggaacacuccugauguggcugggccucaauacgaagaacgggagcaucuccuucaugugucuggcgcuuggaggcgugcugauuuuucucagcaccgccgucucugcugacguggggugcuccguugauuucagcaaaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8948 - RNA, 2365 nt, Artificial Sequence
  KU758874.1 prME-long mRNA Design 3 opt
gggagaaagcuuaccaugagaaucauuaacgcccggaaggagaaaaagcgcagaggcgcugacaccagcguggggaucgucggacugcuccugacaacggccauggcggcugaaguuacccggcgcggcuccgccuacuauauguaccuugauagaaaugacgccggggaggcuauuucuuuccccacaacccugggaaugaacaaaugcuauauccagauuauggaucucggccacaugugugacgccacaaugagcuacgaaugcccuaugcuggaugaggggguggaaccggacgauguggacuguuggugcaauaccacauccaccugggucguguauggaacgugucaucacaagaaaggcgaggcucggcgcucuagacgggccguuacccuucccagccauuccacacgcaagcugcaaaccagaucucagacauggcucgagagccgggaauacaccaagcaccugauccgcguggagaacuggaucuuuagaaauccuggcuucgcgcuggccgcugccgcuauugccuggcuccugggguccagcacgucucagaaagucaucuaucuugugaugauucugcucaucgcgcccgccuacuccauucggugcaucggaguuagcaaccgcgauuuuguggaaggcaugucugggggaacaugggucgacguggugcuggagcauggcgggugugucaccguuauggcucaggauaagccuacaguggacauugagcuugugaccaccacagucuccaauauggccgaagugagaagcuacugcuaugaggcuucuaucuccgauauggccagcgacucccggugucccacgcaaggagaagccuaccuggacaaacagucugauacccaguauguuugcaagagaacacucguggaccgcggcuggggcaacggguguggacuguucggcaaagggagccuggugaccugcgcuaaguuugcgugcuccaagaaaaugacaggaaagagcauccagccugagaaucucgaauaccggauuaugcugucuguccacggcucccaacacagcgggaugaucguuaacgauaccggacaugagacggacgagaauagagccaaaguggaaauuacaccgaacucuccccgcgcugaggccacccuuggcggcuucgggagccugggacucgauugugaaccucggaccggccuggacuuuuccgaucuuuauuaccugacaaugaauaacaagcacuggcucguccauaaagagugguuccacgacaucccccugccuuggcacgccggggcugauaccggaacaccccauuggaauaacaaggaagcccugguggaguuuaaagacgcgcacgcuaagagacagacggucgugguucucggcucucaggagggggccgugcauaccgcccuggcuggcgcccuugaagcugagauggauggagccaagggcaaacugagcuccgggcaccucaagugccgccugaaaauggacaaacuucggcugaagggagucagcuauucucucuguacagcggccuucaccuuuacaaagauuccggcugaaacccugcauggcacggugaccguugaggugcaguacgccgggacagacggaccuugcaagguccccgcucaaauggccguggauaugcagacccugacaccugugggcagacucaucaccgcgaaccccguuaucacggaauccacagagaauagcaaaaugaugcuggagcuugaucccccuuucggggacucuuacauugucaucggcgugggagaaaagaaaauuacccaccacuggcaucgcuccggcagcacaaucgggaaggccuuugaggcuaccgugcggggagccaaaagaauggcuguccugggcgacaccgccugggauuucggguccgugggaggcgcccucaacucucuggggaagggcauucaccagaucuucggagcugcguuuaagagccuguucggcgggauguccugguuuucucaaauccuuauuggaacacuccugauguggcugggccucaauacgaaaaacgggagcaucucccugaugugucuugcccugggaggcguucucauuuuccugagcaccgcugugucugccgacgucgggugcuccguggauuuuagcaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8949 - RNA, 2365 nt, Artificial Sequence
  KY014314.1 prME-long mRNA Design 3 opt
gggagaaagcuuaccaugagaaucauuaacgcccggaaggagaaaaagcgcagaggcgcugacaccagcguggggaucgucggacugcuccugacaacggccauggcggcugaaguuacccggcgcggcuccgccuacuauauguaccuugauagaaaugacgccggggaggcuauuucuuuccccacaacccugggaaugaacaaaugcuauauccagauuauggaucucggccacaugugugacgccacaaugagcuacgaaugcccuaugcuggaugaggggguggaaccggacgauguggacuguuggugcaauaccacauccaccugggucguguauggaacgugucaucacaagaaaggcgaggcucggcgcucuagacgggccguuacccuucccagccauuccacacgcaagcugcaaaccagaucucagacauggcucgagagccgggaauacaccaagcaccugauccgcguggagaacuggaucuuuagaaauccuggcuucgcgcuggccgcugccgcuauugccuggcuccugggguccagcacgucucagaaagucaucuaucuugugaugauucugcucaucgcgcccgccuacuccauucggugcaucggaguuagcaaccgcgauuuuguggaaggcaugucugggggaacaugggucgacguggugcuggagcauggcgggugugucaccguuauggcucaggauaagccuacaguggacauugagcuugugaccaccacagucuccaauauggccgaagugagaagcuacugcuaugaggcuucuaucuccgauauggccagcgacucccggugucccacgcaaggagaagccuaccuggacaaacagucugauacccaguauguuugcaagagaacacucguggaccgcggcuggggcaacggguguggacuguucggcaaagggagccuggugaccugcgcuaaguuugcgugcuccaagaaaaugacaggaaagagcauccagccugagaaucucgaauaccggauuaugcugucuguccacggcucccaacacagcgggaugaucguuaacgauaccggacaugagacggacgagaauagagccaaaguggaaauuacaccgaacucuccccgcgcugaggccacccuuggcggcuucgggagccugggacucgauugugaaccucggaccggccuggacuuuuccgaucuuuauuaccugacaaugaauaacaagcacuggcucguccauaaagagugguuccacgacaucccccugccuuggcacgccggggcugauaccggaacaccccauuggaauaacaaggaagcccugguggaguuuaaagaggcgcacgcuaagagacagacggucgugguucucggcucucaggaaggggccgugcauaccgcccuggcuggcgcccuugaggcugaaauggacggagccaagggccgccugagcuccgggcaccucaaaugccggcugaagauggauaaacuuagacugaagggagucagcuauucucucuguacagcggccuucaccuuuacaaaaauuccggcugagacccugcauggcacggugaccguugaagugcaguacgccgggacagacggaccuugcaagguccccgcucaaauggccguggacaugcagacccugacaccugugggccgccucaucaccgcgaaccccguuaucacggaguccacagagaauagcaagaugaugcuggaacuugaucccccuuucggggacucuuacauugucaucggcgugggagagaaaaagauuacccaccacuggcaucgguccggcagcacaaucgggaaagccuuugaagcuaccgugagaggagccaagcgcauggcuguccugggcgauaccgccugggacuucggguccgugggaggcgcccucaacucucuggggaaaggcauucaccagaucuucggagcugcguuuaagagccuguucggcgggauguccugguuuucucaaauccuuauuggaacacuccugauguggcugggccucaauacgaagaacgggagcaucucccugaugugucuugcccugggaggcguucucauuuuccugagcaccgcugugucugccgaugucgggugcuccguggacuuuagcaaaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8950 - RNA, 2365 nt, Artificial Sequence
  KU926310.1 prME-long mRNA Design 3 opt
gggagaaagcuuaccaugagaaucauuaacgcccggaaggagaaaaagcgcagaggcgcugacaccagcguggggaucgucggacugcuccugacaacggccauggcggcugaaguuacccggcgcggcuccgccuacuauauguaccuugauagaaaugacgccggggaggcuauuucuuuccccacaacccugggaaugaacaaaugcuauauccagauuauggaucucggccacaugugugacgccacaaugagcuacgaaugcccuaugcuggaugaggggguggaaccggacgauguggacuguuggugcaauaccacauccaccugggucguguauggaacgugucaucacaagaaaggcgaggcucggcgcucuagacgggccguuacccuucccagccauuccacacgcaagcugcaaaccagaucucagacauggcucgagagccgggaauacaccaagcaccugauccgcguggagaacuggaucuuuagaaauccuggcuucgcgcuggccgcugccgcuauugccuggcuccugggguccagcacgucucagaaagucaucuaucuugugaugauucugcucaucgcgcccgccuacuccauucggugcaucggaguuagcaaccgcgauuuuguggaaggcaugucugggggaacaugggucgacguggugcuggagcauggcgggugugucaccguuauggcucaggauaagccuacaguggacauugagcuugugaccaccacagucuccaauauggccgaagugagaagcuacugcuaugaggcuucuaucuccgauauggccagcgacucccggugucccacgcaaggagaagccuaccuggacaaacagucugauacccaguauguuugcaagagaacacucguggaccgcggcuggggcaacggguguggacuguucggcaaagggagccuggugaccugcgcuaaguuugcgugcuccaagaaaaugacaggaaagagcauccagccugagaaucucgaauaccggauuaugcugucuguccacggcucccaacacagcgggaugaucguuaacgauaccggacaugagacggacgagaauagagccaaaguggaaauuacaccgaacucuccccgcgcugaggccacccuuggcggcuucgggagccugggacucgauugugaaccucggaccggccuggacuuuuccgaucuuuauuaccugacaaugaauaacaagcacuggcucguccauaaagagugguuccacgacaucccccugccuuggcacgccggggcugauaccggaacaccccauuggaauaacaaggaagcccugguggaguuuaaagacgcgcacgcuaagagacagacggucgugguucucggcucucaggagggggccgugcauaccgcccuggcuggcgcccuugaagcugagauggauggagccaagggccgccugagcuccgggcaccucaaaugccggcugaagauggacaaacuuagacugaagggagucagcuauucucucuguacagcggccuucaccuuuacaaaaauuccggcugaaacccugcauggcacggugaccguugaggugcaguacgccggggcugacggaccuugcaagguccccgcccaaauggcgguggauaugcagacacugaccccugugggccgccucaucacagccaaccccguuaucaccgaauccacggagaauagcaagaugaugcuggagcuugaucccccuuucggggacucuuacauugucaucggcgugggagagaaaaagauuacacaccacuggcaucgguccggcagcaccaucgggaaggcuuuugaagccacagugagaggagcuaaacgcauggccguccugggcgacaccgccugggauuucggguccgugggaggcgcucucaacucucuggggaaaggcauucaccagaucuucggagcggccuuuaagagccuguucggcgggauguccugguuuucucaaauccuuauuggaacccuccugauguggcugggccucaauacaaagaacgggagcaucucccugaugugucuugcucugggaggcguucucauuuuccugagcacggccgugucugccgacgucgggugcuccguggauuuuagcaaaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8951 - RNA, 2365 nt, Artificial Sequence
  KU761560.1 prME-long mRNA Design 3 opt
gggagaaagcuuaccaugagaaucauuaacgccggcaaggagaaaaagcggcgcggggcugacaccaaugugggaaucgucggccugcuccugacaacggccauggcggcugaaguuaccagacgggggagcgccuacuauauguaccuugaucgcaacgacgccggagaggcuauuuccuuccccacaacccugggcaugaauaaaugcuauauccagauuauggaucucgggcacaugugugacgccacaaugucuuacgaaugcccuaugcuggaugagggaguggaaccggacgauguggacuguuggugcaacaccacaagcaccugggucguguauggcacgugucaucacaagaaaggcgaggcuagacggucccgcagagccguuacccuucccucucauagcacacggaagcugcaaacccgcucccagacauggcucgagucuagagaauacaccaagcaccugauccggguggagaauuggaucuuucgcaacccuggguucgcgcuggccgcugccgcuauugccuggcuccugggaagcuccacgagccagaaagucaucuaucuugugaugauucugcucaucgcgcccgccuacucuauuagaugcaucggcguuuccaaucgggauuuuguggaagggaugagcggaggcacaugggucgacguggugcuggagcaugggggaugugucaccguuauggcucaggauaagccuacaguggacauugagcuugugaccaccacagucucuaacauggccgaagugcgcuccuacugcuaugaggcuagcaucucugauauggccuccgacagcagaugucccacgcaaggcgaagccuaccuggacaaacaguccgauacccaguauguuugcaagcggacacucguggacagaggcugggggaauggauguggccuguucgggaaaggaucucuggugaccugcgcuaaguuugcgugcagcaagaaaaugacaggcaaguccauccagccugagaaccucgaauaccgcauuaugcugagcguccacgggucucaacacuccggaaugaucguuaaugauaccggccaugagacggacgagaaccgggccaaaguggaaauuacaccgaauagccccagagcugaggccacccuuggcggguucggaucucugggccucgauugugaaccucgcaccgggcuggacuuuagcgaucuuuauuaccugacaaugaacaauaagcacuggcucguccauaaagagugguuccacgacaucccccugccuuggcacgccggagcugauaccggcacaccccauuggaacaacaaggaagcccugguggaguuuaaagacgcgcacgcuaagcggcagacggucgugguucucgggucccaggagggcgccgugcauaccgcccuggcuggagcccuugaagcugagauggauggcgccaaggggagacugucuagcggacaccucaaaugccgccugaagauggacaaacuucggcugaagggcgucuccuauagccucuguacagcggccuucaccuuuacaaaaauuccggcugaaacccugcaugggacggugaccguugaggugcaguacgccggaacagacggcccuugcaagguccccgcucaaauggccguggauaugcagacccugacaccuguggggagacucaucaccgcgaaucccguuaucacggaaucuacagagaacuccaagaugaugcuggagcuugaucccccuuucggcgacagcuacauugucaucggagugggcgagaaaaagauuacccaccacuggcaucgcucuggguccacaaucggaaaagccuuugaagcuaccgugcggggcgccagacgcauggcuguccugggggacaccgccugggauuucggaagcgugggcggggcccucaauucccugggcaagggcauucaccagaucuucggagcugcguuuaaaucucuguucgggggaaugagcugguuuucccaaauccuuauuggcacacuccugauguggcuggggcucaacacgaagaauggaucuaucagccugaugugucuugcccugggcgggguucucauuuuccuguccaccgcugugagcgccgacgucggcugcucuguggauuuuuccaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8952 - RNA, 2365 nt, Artificial Sequence
  KY317939.1 prME-long mRNA Design 3 opt
gggagaaagcuuaccaugagaaucauuaacgcccggaaggagaaaaagcgcagaggcgcugaaaccagcguggggaucgucggacugcuccugacaacggccauggcggcugagguuacccggcgcggcuccgccuacuauauguaccuugacagaaaagaugccggggaagcuauuucuuuccccacaacccugggaaugaauaagugcuauauccagauuauggaccucggccacaugugugaugccacaaugagcuacgagugcccuaugcuggacgaagggguggagccggaugacguggauuguuggugcaacaccacauccaccugggucguguauggaacgugucaucacaaaaagggcgaggcucggcgcucuagacgggccguuacccuucccagccauuccacacgcaagcugcaaaccagaucucagacauggcucgaaagccgggaguacaccaaacaccugauccgcguggaaaauuggaucuuuagaaacccuggcuucgcgcuggccgcugccgcuauugccuggcuccugggguccagcacgucucagaaggucaucuaucuugugaugauucugcucaucgcgcccgccuacuccauucggugcaucggaguuagcaaucgcgacuuuguggagggcaugucugggggaacaugggucgauguggugcuggagcauggcgggugugucaccguuauggcucaggacaaaccuacaguggauauugaacuugugaccaccacagucuccaacauggccgaggugagaagcuacugcuaugaggcuucuaucuccgacauggccagcgauucccggugucccacgcaaggagaagccuaccuggacaagcagucugacacccaguauguuugcaaaagaacacucguggaucgcggcuggggcaauggguguggacuguucggcaaggggagccuggugaccugcgcuaaguuugcgugcuccaaaaagaugacaggaaaaagcauccagccugaaaaccucgaguaccggauuaugcugucuguccacggcucccaacacagcgggaugaucguuaaugacaccggacaugagacggaugaaaacagagccaagguggagauuacacccaauucuccgcgcgcugaagccacccuuggcggcuucgggagccugggacucgacugugagccucggaccggccuggauuuuuccgaccuuuauuaccugacaaugaacaauaaacacuggcucguccauaaggaaugguuccacgauaucccccugccuuggcacgccggggcugacaccggaacaccccauuggaacaauaaagaggcccugguggaguuuaaggaugcgcacgcuaagagacagacggucgugguucucggcucucaggaaggggccgugcauaccgcccuggcuggcgcccuugaggcugaaauggacggagccaaaggccgccugagcuccgggcaccucaagugccggcugaaaauggauaaacuuagacugaagggagucagcuauucucucuguacagcggccuucaccuuuacaaagauuccggcugagacccugcauggcacggugaccguugaagugcaguacgccgggacagacggaccuugcaagguccccgcucaaauggccguggacaugcagacccugacaccugugggccgccucaucaccgcgaaccccguuaucacggaguccacagagaacagcaaaaugaugcuggaacuugaucccccuuucggggacucuuacauugucaucggcgugggagagaagaaaauuacccaccacuggcaucgguccggcagcacaaucgggaaggccuuugaagcuaccgugagaggagccaaacgcauggcuguccugggcgauaccgccugggacuucggguccgugggaggcgcccucaauucucuggggaagggcauucaccagaucuucggagcugcguuuaagagccuguucggcgggauguccugguuuucucaaauccuuauuggaacacuccugauguggcugggccucaacacgaaaaaugggagcaucucccugaugugucuugcccugggaggcguucucauuuuccugagcaccgcugugucugccgaugucgggugcuccguggacuuuagcaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8953 - RNA, 2365 nt, Artificial Sequence
  KY075937.1 prME-long mRNA Design 3 opt
gggagaaagcuuaccaugagaaucauuaacgcccggaaggagaaaaagcgcagaggcgcugacaccagcguggggaucgucggacugcuccugacaacggccauggcggcugaaguuacccggcgcggcuccgccuacuauauguaccuugauagaaaugacgccggggaggcuauuucuuuccccacaacccugggaaugaacaaaugcuauauccagauuauggaucucggccacaugugugacgccacaaugagcuacgaaugcccuaugcuggaugaggggguggaaccggacgauguggacuguuggugcaauaccacauccaccugggucguguauggaacgugucaucacaagaaaggcgaggcucggcgcucuagacgggccguuacccuucccagccauuccacacgcaagcugcaaaccagaucucagacauggcucgagagccgggaauacaccaagcaccugauccgcguggagaacuggaucuuuagaaauccuggcuucgcgcuggccgcugccgcuauugccuggcuccugggguccagcacgucucagaaagucaucuaucuugugaugauucugcucaucgcgcccgccuacuccauucggugcaucggaguuagcaaccgcgauuuuguggaaggcaugucugggggaacaugggucgacguggugcuggagcauggcgggugugucaccguuauggcucaggauaagccuacaguggacauugagcuugugaccaccacagucuccaauauggccgaagugagaagcuacugcuaugaggcuucuaucuccgauaugguuagcgacucccggugucccacgcaaggagaagccuaccuggacaaacagucugauacccaguaugugugcaagagaacacucgucgaccgcggcuggggcaacggguguggacuguucggcaaagggagccuggugaccugcgccaaguuugcuugcuccaagaaaaugacaggaaagagcauccagccugagaaucucgaauaccggauuaugcugucuguucacggcucccaacacagcgggaugaucgugaacgauaccggacaugagacggacgagaauagagcgaaagucgaaauuacaccgaacucuccccgcgccgaggcuacccuuggcggcuucgggagccugggacucgauugugaaccucggaccggccuggacuuuuccgaucuuuauuaccugacaaugaauaacaagcacuggcucgugcauaaagagugguuccacgacaucccccugccuuggcacgccggggccgauaccggaacaccccauuggaauaacaaggaagcucuggucgaguuuaaagacgcccacgcgaagagacagacggugguugugcucggcucucaggagggggcuguccauaccgcccuggccggcgcucuugaagccgagauggauggagcuaagggccgccugagcuccgggcaccucaaaugccggcugaagauggacaaacuuagacugaagggagugagcuauucucucuguacagccgcguucaccuuuacaaaaauuccggccgaaacccugcauggcacgguuaccguggagguccaguacgcugggacagacggaccuugcaaggugcccgcccaaauggcuguggauaugcagacccugacaccuguuggccgccucaucaccgccaaccccgucaucacggaauccacagagaauagcaagaugaugcuggagcuugaucccccuuucggggacucuuacauugugaucggcgugggagagaaaaagauuacccaccacuggcaucgguccggcagcacaaucgggaaagcguuugaagccaccgucagaggagcuaagcgcauggccgugcugggcgacaccgcuugggauuucggguccguuggaggcgcccucaacucucuggggaaaggcauucaccagaucuucggagccgcuuuuaagagccuguucggcgggauguccugguuuucucaaauccuuauuggaacacuccugauguggcugggccucaauacgaagaacgggagcaucucccugaugugucuugcgcugggaggcgugcucauuuuccugagcaccgccgucucugcugacguggggugcuccguugauuuuagcaaaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8954 - RNA, 2365 nt, Artificial Sequence
  LC191864.1 prME-long mRNA Design 3 opt
gggagaaagcuuaccaugagaaucauuaacgcccggaaggagaaaaagcgcagaggcgcugacaccaauguggggaucgucggacugcuccugacaacggccauggcggcugaaguuacccggcgcggcagcgccuacuauauguaccuugauagaaacgacgccggggaggcuauuuccuuccccacaacccugggaaugaauaaaugcuauauccagauuauggaucucggccacaugugugacgccacaaugucuuacgaaugcccuaugcuggaugaggggguggaaccggacgauguggacuguuggugcaacaugaccagcacaugggucguguauggaaccugucaucacaagaaaggcgaggcucggcgcuccagacgggccguuacgcuucccucucauagcacccgcaagcugcaaacaagaucccagaccuggcucgagucucgggaauacacaaagcaccugauccgcguggagaauuggaucuuuagaaacccuggcuucgcgcuggccgcugccgcuauugccuggcuccuggggagcuccaccagccagaaagucaucuaucuugugaugauucugcucaucgcgcccgccuacucuauucggugcaucggaguuuccaaucgcgauuuuguggaaggcaugagcgggggaacgugggucgacguggugcuggagcauggcgggugugucacaguuauggcucaggauaagccuaccguggacauugagcuugugacaaccaccgucucuaacauggccgaagugagauccuacugcuaugaggcuagcaucucugauauggccuccgacagccggugucccacacaaggagaagccuaccuggacaaacaguccgauacgcaguauguuugcaagagaacccucguggaccgcggcuggggcaauggguguggacuguucggcaaagggucucuggucacaugcgcuaaguuugcgugcagcaagaaaaugaccggaaaguccauccagccugagaaccucgaauaccggauuaugcugagcgugcacggcucucaacacuccgggaugaucguuaaugauacaggacaugagaccgacgagaacagagccaaaguggaaauuacgccgaauagcccccgcgcugaggccacacuuggcggcuucgggucucugggacucgauugugaaccucggaccggccuggacuuuagcgaucuuuauuaccugaccaugaacaauaagcacuggcucguccauaaagagugguuccacgacaucccccugccuuggcacgccggggcugauacaggaacaccccauuggaacaacaaggaagcccugguggaguuuaaagacgcgcacgcuaagagacagaccgucgugguucucggcucccaggagggggccgugcauacggcccuggcuggcgcccuugaagcugagauggauggagccaagggccgccugucuagcgggcaccucaaaugccggcugaagauggacaaacuuagacugaagggagucuccuauagccucuguaccgcggccuucacauuuaccaaaauuccggcugaaacacugcauggcaccgugacgguugaggugcaguacgccgggaccgacggaccuugcaagguccccgcucaaauggccguggauaugcagacacugaccccugugggccgccucaucacagcgaaucccguuaucaccgaaucuacggagaacuccaagaugaugcuggagcuugaucccccuuucggggacagcuacauugucaucggcgugggagagaaaaagauuacacaccacuggcaucggucuggcuccaccaucgggaaagccuuugaagcuacagugagaggagccaagcgcauggcuguccugggcgacaccgccugggauuucgggagcgugggaggcgcccucaauucccuggggaaaggcauucaccagaucuucggagcugcguuuaagucucuguucggcgggaugagcugguuuucccaaauccuuauuggaacccuccugauguggcugggccucaacacaaagaaugggucuaucagccugaugugucuugcccugggaggcguucucauuuuccuguccacggcugugagcgccgacgucgggugcucuguggauuuuuccaaaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8955 - RNA, 2365 nt, Artificial Sequence
  KX447517.1 prME-long mRNA Design 3 opt
gggagaaagcuuaccaugagaaucauuaacgcccggaaggagaaaaagcgcagaggcgcugacaccagcguggggaucgucggacugcuccugacaacggccauggcggcugaaguuacccggcgcggcuccgccuacuauauguaccuugauagaaaugacgccggggaggcuauuucuuuccccacaacccugggaaugaacaaaugcuauauccagauuauggaucucggccacaugugugacgccacaaugagcuacgaaugcccuaugcuggaugaggggguggaaccggacgauguggacuguuggugcaauaccacauccaccugggucguguauggaacgugucaucacaagaaaggcgaggcucggcgcucuagacgggccguuacccuucccagccauuccacacgcaagcugcaaaccagaucucagacauggcucgagagccgggaauacaccaagcaccugauccgcguggagaacuggaucuuuagaaauccuggcuucgcgcuggccgcugccgcuauugccuggcuccugggguccagcacgucucagaaagucaucuaucuugugaugauucugcucaucgcgcccgccuacuccauucggugcaucggaguuagcaaccgcgauuuuguggaaggcaugucugggggaacaugggucgacguggugcuggagcauggcgggugugucaccguuauggcucaggauaagccuacaguggacauugagcuugugaccaccacagucuccaauauggccgaagugagaagcuacugcuaugaggcuucuaucuccgauauggccagcgacucccggugucccacgcaaggagaagccuaccuggacaaacagucugauacccaguauguuugcaagagaacacucguggaccgcggcuggggcaacggguguggacuguucggcaaagggagccuggugaccugcgcuaaguuugcgugcuccaagaaaaugacaggaaagagcauccagccugagaaucucgaauaccggauuaugcugucuguccacggcucccaacacagcgggaugaucguuaacgauaccggacaugagacggacgagaauagagccaaaguggaaauuacaccgaacucuccccgcgcugaggccgcccuuggcggcuucgggagccugggacucgauugugaaccucggaccggccuggacuuuuccgaucuuuauuaccugaccaugaauaacaagcacuggcucguccauaaagagugguuccacgacaucccccugccuuggcacgcuggggccgauacaggaacaccccauuggaauaacaaggaagcgcugguggaguuuaaagacgcucacgccaagagacagaccgucgugguucucggcucucaggagggggccgugcauacggcucuggccggcgcucuugaagccgagauggauggagcgaagggccgccugagcuccgggcaccucaaaugccggcugaagauggacaaacuuagacugaagggagucagcuauucucucuguaccgccgcuuucacauuuaccaaaauuccggccgaaacacugcauggcaccgugacgguugaggugcaguacgcugggaccgacggaccuugcaagguccccgcccaaauggcgguggauaugcagacacugaccccugugggccgccucaucacagccaaccccguuaucaccgaauccacggagaauagcaagaugaugcuggagcuugaucccccuuucggggacucuuacauugucaucggcgugggagagaaaaagauuacacaccacuggcaucgguccggcagcaccaucgggaaggcuuuugaagccacagugagaggagcuaaacgcauggccguccugggcgacaccgccugggauuucggguccgugggaggcgcucucaacucucuggggaaaggcauucaccagaucuucggagcggccuuuaagagccuguucggcgggauguccugguuuucucaaacccuuaucggaacacuccugauguggcugggccucaauacgaagaacgggagcauuucccugaugugucuugcucugggaggcguucucaucuuccugagcaccgccgugucugccgacgucgggugcuccguggauuuuagcaaaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8956 - RNA, 2365 nt, Artificial Sequence
  KU922923.1 prME-long mRNA Design 3 opt
gggagaaagcuuaccaugagaaucauuaacgcccggaaggagaaaaagcgcagaggcgcugaaaccagcguggggaucgucggacugcuccugacaacggccauggcggcugagguuacccggcgcggcuccgccuacuauauguaccuugacagaaaugaugccggggaagcuauuucuuuccccacaacccugggaaugaacaaaugcuauauccagauuauggaccucggccacaugugugaugccacaaugagcuacgagugccccaugcuggacgaagggguggagccggaugacguggauuguuggugcaauaccacauccaccugggucguguauggaacgugucaucacaagaaaggcgaggcucggcgcucuagacgggccguuacccuucccagccauuccacacgcaagcugcaaaccagaucucagacauggcucgaaagccgggaguacaccaagcaccugauccgcguggaaaacuggaucuuuagaaauccuggcuucgcgcuggccgcugccgcuauugccuggcuccugggguccagcacgucucagaaagucaucuaucuugugaugauucugcucaucgcgcuggccuacuccauucggugcaucggaguuagcaaccgcgacuuuguggagggcaugucugggggaacaugggucgauguggugcuugagcauggcgggugugucaccguuauggcucaggacaagcccacaguggauauugaacuggugaccaccacagucuccaauauggccgaggugagaagcuacugcuaugaggcuucuaucuccgacauggccagcgauucccgguguccuacgcaaggagaagccuaccucgacaaacagucugacacccaguauguuugcaagagaacacugguggaucgcggcuggggcaacggguguggacuguucggcaaagggagccucgugaccugcgcuaaguuugcgugcuccaagaaaaugacaggaaagagcauccagcccgaaaaucuggaguaccggauuaugcuuucuguccacggcucccaacacagcgggaugaucguuaacgacaccggacaugagacggaugaaaauagagccaaaguggagauuacaccuaacucuccgcgcgcugaagccacccugggcggcuucgggagccucggacuggacugugagccccggaccggccuugauuuuuccgaccuguauuaccucacaaugaauaacaagcacuggcugguccauaaagaaugguuccacgauaucccucugcccuggcacgccggggcugacaccggaacaccucauuggaauaacaaggaggcccucguggaguuuaaagaugcgcacgcuaagagacagacggucgugguucugggcucucaggaaggggccgugcauaccgcccuugcuggcgcccuggaggcugaaauggacggagccaagggccgccucagcuccgggcaccugaaaugccggcuuaagauggauaaacugagacucaagggagucagcuauucucuguguacagcggccuucaccuuuacaaaaauucccgcugagacccugcauggcacggugaccguugaagugcaguacgccgggacagacggaccgugcaaggucccugcucaaauggccguggacaugcagacccucacacccgugggccgccugaucaccgcgaacccuguuaucacggaguccacagagaauagcaagaugaugcuugaacuggauccucccuucggggacucuuacauugucaucggcgugggagagaaaaagauuacccaccacuggcaucgguccggcagcacaaucgggaaagccuuugaagcuaccgugagaggagccaagcgcauggcuguccucggcgauaccgccugggacuucggguccgugggaggcgcccugaacucucuggggaaaggcauucaccagaucuucggagcugcguuuaagagccuuuucggcgggauguccugguuuucucaaauccucauuggaacacugcugauguggcucggccugaauacgaagaacgggagcaucucccuuaugugucuggcccucggaggcguucugauuuuccugagcaccgcugugucugccgaugucgggugcuccguggacuuuagcaaaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8957 - RNA, 2365 nt, Artificial Sequence
  KY003156.1 prME-long mRNA Design 3 opt
gggagaaagcuuaccaugagaaucauuaacgcccggaaggagaaaaagcgcagaggcgcugacaccagcguggggaucgucggacugcuccugacaacggccauggcggcugaaguuacccggcgcggcuccgccuacuauauguaccuugauagaaaugacgccggggaggcuauuucuuuccccacaacccugggaaugaacaaaugcuauauccagauuauggaucucggccacaugugugacgccacaaugagcuacgaaugcccuaugcuggaugaggggguggaaccggacgauguggacuguuggugcaauaccacauccaccugggucguguauggaacgugucaucacaagaaaggcgaggcucggcgcucuagacgggccguuacccuucccagccauuccacacgcaagcugcaaaccagaucucagacauggcucgagagccgggaauacaccaagcaccugauccgcguggagaacuggaucuuuagaaauccuggcuucgcgcuggccgcugccgcuauugccuggcuccugggguccagcacgucucagaaagucaucuaucuugugaugauucugcucaucgcgcccgccuacuccauucggugcaucggaauuagcaaccgcgauuuuguugaaggcaugucugggggaacauggguggacgucgugcuggagcauggcgggugugugaccgucauggcucaggauaagccuacaguugacaucgagcuugugaccaccacaguguccaauauggccgaagucagaagcuacugcuaugaggcuucuaucuccgauauggccagcgacucccggugucccacgcaaggagaagccuaccuggacaaacagucugauacccaguaugugugcaagagaacacucguugaccgcggcuggggcaacggguguggacuguucggcaaagggagccuggugaccugcgcuaaguuugcgugcuccaagaaaaugacaggaaagagcauucagccugagaaucucgaauaccggaucaugcugucuguccacggcucccaacacagcgggaugauugugaacgauaccggacaugagacggacgagaauagagccaaaguugaaaucacaccgaacucuccccgcgcugaggccacccuuggcggcuucgggauucugggacucgauugugaaccucggaccggccuggacuuuagcgaucuuuauuaccugacaaugaauaacaagcacuggcucgugcauaaagagugguuccacgacaucccccugccuuggcacgccggggcugauaccggaacaccccauuggaauaacaaggaagcccuggucgaguuuaaagacgcgcacgcuaagagacagacgguggucgugcucggcucccaggagggggccguucauaccgcccuggcuggcgcccuugaagcugagauggauggagccaagggccgccugucuagcgggcaccucaaaugccggcugaagauggacaaacuuagacugaagggaguguccuauagccucuguacagcggccuucaccuuuacaaaaaucccggcugaaacccugcauggcacggucaccguggagguucaguacgccgggacagacggaccuugcaaggugcccgcucaaauggccgucgauaugcagacccugacaccugugggccgccucauuaccgcgaaccccgugaucacggaaucuacagaaaauuccaagaugaugcuggagcuugaucccccuuucggggacagcuacauuguuaucggcgucggagagaaaaagauuacccaccacuggcaucggucuggcuccacaaucgggaaagccuuugaggcuaccgugagaggagccaagcgcauggcugugcugggcgacaccgccugggauuucgggagcgucggaggcgcccucaacucccuggggaaaggcauccaccagauuuucggagcugcguuuaagucucuguucggcgggaugagcugguuuucccaaauccuuauuggaacacuccugauguggcugggccucaauacgaagaacgggucuaucagccugaugugucuugcccugggaggcgugcucauuuuccuguccaccgcuguuagcgccgacguggggugcucugucgauuuuuccaaaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8958 - RNA, 2365 nt, Artificial Sequence
  KU312313.1 prME-long mRNA Design 3 opt
gggagaaagcuuaccaugagaaucauuaacgcccggaaggagaaaaagcgcagaggcgcugacaccagcguggggaucgucggacugcuccugacaacggccauggcggcugaaguuacccggcgcggcuccgccuacuauauguaccuugauagaaaugacgccggggaggcuauuucuuuccccacaacccugggaaugaacaaaugcuauauccagauuauggaucucggccacacaugugacgccaccaugagcuacgaaugcccuaugcuggaugaggggguggaaccggacgauguggacuguuggugcaauacaaccuccacgugggucguguauggaaccugucaucacaagaaaggcgaggcucggcgcucuagacgggccguuacacuucccagccauuccauccgcaagcugcaaaccagaucucagacauggcucgagagccgggaauacaccaagcaccugauccgcguggagaacuggauuuuuagaaauccuggcuucgcgcuggccgcugccgcuaucgccuggcuccugggguccagcacgucucagaaagucauuuaucuugugaugauccugcucauugcgcccgccuacuccauccggugcauuggaguuagcaaccgcgauuuuguggaaggcaugucugggggaacaugggucgacguggugcuggagcauggcgggugugucaccguuauggcucaggauaagccuacaguggacaucgagcuugugaccaccacagucuccaauauggccgaagugagaagcuacugcuaugaggcuucuaucuccgauauggccagcgacucccggugucccacgcaaggagaagccuaccuggacaaacagucugauacccaguauguuugcaagagaacacucguggaccgcggcuggggcaacggguguggacuguucggcaaagggagccuggugaccugcgcuaaguuugcgugcuccaagaaaaugacaggaaagagcauucagccugagaaucucgaauaccggaucaugcugucuguccacggcucccaacacagcgggaugauuguuaacgauaccggacaugagacggacgagaauagagccaaaguggaaaucacaccgaacucuccccgcgcugaggccacccuuggcggcuucgggagccugggacucgauugugaaccucggaccggccuggacuuuuccgaucuuuauuaccugacaaugaauaacaagcacuggcucguccauaaagagugguuccacgacauuccccugccuuggcacgccggggcugauaccggaacaccccauuggaauaacaaggaagcccugguggaguuuaaagacgcgcacgcuaagagacagacggucgugguucucggcucucaggagggggccgugcauaccgcccuggcuggcgcccuugaagcugagauggauggagccaagggccgccugagcuccgggcaccucaaaugccggcugaagauggacaaacuuagacugaagggagucagcuauucucucuguacagcggccuucaccuuuacaaaaaucccggcugaaacccugcauggcacggugaccguugaggugcaguacgccgggacagacggaccuugcaagguccccgcucaaauggccguggauaugcagacccugacaccugugggccgccucaucaccgcgaaccccguuauuacggaauccacagagaauagcaagaugaugcuggagcuugaucccccuuucggggacucuuacaucgucauuggcgugggagagaaaaagaucacccaccacuggcaucgguccggcagcacaauugggaaagccuuugaagcuaccgugagaggagccaagcgcauggcuguccugggcgacaccgccugggauuucggguccgugggaggcgcccucaacucucuggggaaaggcauccaccagaucuucggagcugcguuuaagagccuguucggcgggauguccugguuuucucaaauucuuaucggaacacuccugauguggcugggccucaaugccaagaacgggagcauuucccugaugugucuugcucugggaggcguucucaucuuccugagcacggccgugucugccgacgucgggugcuccguggauuuuagcaaaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8959 - RNA, 2365 nt, Artificial Sequence
  KY075935.1 prME-long mRNA Design 3 opt
gggagaaagcuuaccaugagaaucauuaacgcccggaaggagaaaaagcgcagaggcgcugacaccagcguggggaucgucggacugcuccugacaacggccauggcggcugaaguuacccggcgcggcuccgccuacuauauguaccuugauagaaaugacgccggggaggcuauuucuuuccccacaacccugggaaugaacaaaugcuauauccagauuauggaucucggccacaugugugacgccacaaugagcuacgaaugcccuaugcuggaugaggggguggaaccggacgauguggacuguuggugcaauaccacauccaccugggucguguauggaacgugucaucacaagaaaggcgaggcucaacggucucgcagagccguuacccuucccagccauuccacacggaagcugcagacccgcucucagacauggcucgagagcagagaauacaccaagcaccugauccggguggagaacuggaucuuucgcaauccuggcuucgcgcuggccgcugccgcuauugccuggcuccugggguccagcacgucucagaaagucaucuaucuugugaugauucugcucaucgcgcccgccuacuccauuagaugcaucggaguuagcaaccgggauuuuguggaaggcaugucugggggaacaugggucgacguggugcuggagcauggcgggugugucaccguuauggcucaagauaagccuacaguggacauugagcuugugaccaccacagucuccaauauggccgaagugcgcagcuacugcuaugaggcuucuaucuccgauauggccagcgacuccagaugucccacgcagggagaagccuaccuggacaaacagucugauacccaguauguuugcaagcggacacucguggacagaggcuggggcaacggguguggacuguucggcaaagggagccuggugaccugcgcuaaguuugcgugcuccaagaaaaugacaggaaagagcauccaaccugagaaucucgaauaccgcauuaugcugucuguccacggcucccagcacagcgggaugaucguuaacgauaccggacaugagacggacgagaaucgggccaaaguggaaauuacaccgaacucucccagagcugaggccacccuuggcggcuucgggagccugggacucgauugugaaccucgcaccggccuggacuuuuccgaucuuuauuaccugacaaugaauaacaagcacuggcucguccauaaagagugguuccacgacaucccccugccuuggcacgccggggcugauaccggaacaccccauuggaauaacaaggaagcccugguggaguuuaaagacgcgcacgcuaagcggcagacggucgugguucucggcucucaggagggggccgugcauaccgcccuggcuggcgcccuugaagcugagauggauggagccaagggcagacugagcuccgggcaccucaaaugccgccugaagauggacaaacuucggcugaagggagucagcuauucucucuguacagcggccuucaccuuuacaaaaauuccggcugaaacccugcauggcacggugaccguugaggugcaauacgccgggacagacggaccuugcaagguccccgcucagauggccguggauaugcagacccugacaccugugggcagacucaucaccgcgaaccccguuaucacggaauccacagagaauagcaagaugaugcuggagcuugaucccccuuucggggacucuuacauugucaucggcgugggagagaaaaagauuacccaccacuggcaucgcuccggcagcacaaucgggaaagccuuugaagcuaccgugcggggagccaagagaauggcuguccugggcgacaccgccugggauuucggguccgugggaggcgcccucaacucucuggggaaaggcauucaccaaaucuucggagcugcguuuaagagccuguucggcgggauguccugguuuucucagauccuuauuggaacacuccugauguggcugggccucaauacgaagaacgggagcaucucccugaugugucuugcccugggaggcguucucauuuuccugagcaccgcugugucugccgacgucgggugcuccguggauuuuagcaaaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8960 - RNA, 2365 nt, Artificial Sequence
  KY014320.1 prME-long mRNA Design 3 opt
gggagaaagcuuaccaugagaaucauuaacgcccggaaggagaaaaagcgcagaggcgcugacaccagcguggggaucgucggacugcuccugacaacggccauggcggcugaaguuacccggcgcggcuccgccuacuauauguaccuugauagaaaugacgccggggaggcuauuucuuuccccacaacccugggaaugaacaaaugcuauauccagauuauggaucucggccacaugugugacgccacaaugagcuacgaaugcccuaugcuggaugaggggguggaaccggacgauguggacuguuggugcaauaccacauccaccugggucguguauggaacgugucaucacaagaaaggcgaggcucggcgcucuagacgggccguuacccuucccagccauuccacacgcaagcugcaagcgagaucucagaccuggcucgagagccgggaauacacaaagcaccugauccgcguggagaacuggaucuuuagaaauccuggcuucgcccuggcugccgcugccauugcguggcuccugggguccagcaccucucagaaagucaucuaucuugugaugauucugcucaucgcccccgcuuacuccauucggugcaucggaguuagcaaccgcgauuuuguggaaggcaugucugggggaacgugggucgacguggugcuggagcauggcgggugugucacaguuauggcccaggauaagccuaccguggacauugagcuugugacaaccaccgucuccaauauggcugaagugagaagcuacugcuaugaggccucuaucuccgauauggccagcgacucccggugucccacacaaggagaggcuuaccuggacaaacagucugauacgcaguauguuugcaagagaacccucguggaccgcggcuggggcaacggguguggacuguucggcaaagggagccuggucacaugcgcgaaguuugccugcuccaagaaaaugaccggaaagagcauccagccugaaaaucucgaauaccggauuaugcugucugugcacggcucccaacacagcgggaugaucguuaacgauacaggacaugagaccgacgagaauagagcuaaaguggaaauuacgccgaacucuccccgcgccgaggccacacuuggcggcuucgggagccugggacucgauugugaaccucggaccggccuggacuuuuccgaucuuuauuaccugaccaugaauaacaagcacuggcucguccauaaagagugguuccacgacaucccccugccuuggcacgcuggggccgauacaggaacaccccauuggaauaacaaggaagcgcugguggaguuuaaagacgcucacgccaagagacagaccgucgugguucucggcucucaggagggggccgugcauacggcucuggccggcgcucuugaagccgagauggauggagcgaagggccgccugagcuccgggcaccucaaaugccggcugaagauggacaaacuuagacugaagggagucagcuauucucucuguaccgccgcuuucacauuuaccaaaauuccggccgaaacacugcauggcaccgugacgguugaggugcaguacgcugggaccgacggaccuugcaagguccccgcccaaauggcgguggauaugcagacacugaccccugugggccgccucaucacagccaaccccguuaucaccgaauccacggagaauagcaagaugaugcuggagcuugaucccccuuucggggacucuuacauugucaucggcgugggagagaaaaagauuacacaccacuggcaucgguccggcagcaccaucgggaaggcuuuugaagccacagugagaggagcuaaacgcauggccguccugggcgacaccgccugggauuucggguccgugggaggcgcucucaacucucuggggaaaggcauucaccagaucuucggagcggccuuuaagagccuguucggcgggauguccugguuuucucaaauccuuauuggaacccuccugauguggcugggccucaauacaaagaacgggagcaucucccugaugugucuugcucugggaggcguucucauuuuccugagcacggccgugucugccgacgucgggugcuccguggauuuuagcaaaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8961 - RNA, 2365 nt, Artificial Sequence
  KX827309.1 prME-long mRNA Design 3 opt
gggagaaagcuuaccaugagaaucauuaacgcccggaaggagaaaaagcgcagaggcgcugacaccagcguggggaucgucggacugcuccugacaacggccauggcggcugaaguuacccggcgcggcuccgccuacuauauguaccuugauagaucugacgccggggaggcuauuagcuuccccacaacccugggaaugaauaaaugcuauauccagauuauggaucucggccacaugugugacgccacaauguccuacgaaugcccuaugcuggaugaggggguggaaccggacgauguggacuguuggugcaacaccacaucuaccugggucguguauggaacgugucaucacaagaaaggcgaggcucggcgcagcagacgggccguuacccuucccucccauucuacacgcaagcugcaaaccagaagccagacauggcucgagucccgggaauacaccaagcaccugauccgcguggagaauuggaucuuuagaaacccuggcuucgcgcuggccgcugccgcuauugccuggcuccuggggagcucuacgucccagaaagucaucuaucuugugaugauucugcucaucgcgcccgccuacagcauucggugcaucggaguuucuaaucgcgauuuuguggaaggcauguccgggggaacaugggucgacguggugcuggagcauggcgggugugucaccguuauggcucaggauaagccuacaguggacauugagcuugugaccaccacagucagcaacauggccgaagugagaucuuacugcuaugaggcuuccaucagcgauauggccuccgacucucggugucccacgcaaggagaagccuaccuggacaaacagagcgauacccaguauguuugcaagagaacacucguggaccgcggcuggggcaauggguguggacuguucggcaaagggucccuggugaccugcgcuaaguuugcgugcagcaagaaaaugacaggaaagucuauccagccugagaaccucgaauaccggauuaugcuguccguccacggcagccaacacucugggaugaucguuaaugauaccggacaugagacggacgagaacagagccaaaguggaaauuacaccgaauagcccccgcgcugaggccacccuuggcggcuucgggucccugggacucgauugugaaccucggaccggccuggacuuuucugaucuuuauuaccugacaaugaacaauaagcacuggcucguccauaaagagugguuccacgacaucccccugccuuggcacgccggggcugauaccggaacaccccauuggaacaauaaggaagcccugguggaguuuaaagacgcgcacgcuaagagacagacggucgugguucucggcagccaggagggggccgugcauaccgcccuggcuggcgcccuugaagcugagauggauggagccaagggccgccuguccagcgggcaccucaaaugccggcugaagauggacaaacuuagacugaagggagucucuuauucccucuguacagcggccuucaccuuuacaaaaauuccggcugaaacccugcauggcacggugaccguugaggugcaguacgccgggacagacggaccuugcaagguccccgcucaaauggccguggauaugcagacccugacaccugugggccgccucaucaccgcgaaccccguuaucacggaaagcacagagaacucuaagaugaugcuggagcuugaucccccuuucggggacuccuacauugucaucggcgugggagagaaaaagauuacccaccacuggcaucggagcggcuccacaaucgggaaagccuuugaagcuaccgugagaggagccaagcgcauggcuguccugggcgacaccgccugggauuucgggucugugggaggcgcccucaauagccuggggaaaggcauucaccagaucuucggagcugcguuuaagucccuguucggcgggaugucuugguuuagccaaauccuuauuggaacacuccugauguggcugggccucaacacgaagaauggguccaucagccugaugugucuugcccugggaggcguucucauuuuccugucuaccgcuguguccgccgacgucgggugcagcguggauuuuucuaaaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8962 - RNA, 2365 nt, Artificial Sequence
  KU681081.3 prME-long mRNA Design 3 opt
gggagaaagcuuaccaugagaaucauuaacgcccggaaggagaaaaagcgcagaggcaccgacacaagcguggggaucgucggacugcuccugacgaccgcuauggccgcggaaguuacacggcgcggcuccgcuuacuauauguaccuugauagaucugacgccggggaggccauuagcuuccccaccacacugggaaugaauaaaugcuauauccagauuauggaucucggccacaugugugacgcuaccauguccuacgaaugcccuaugcuggaugaggggguggaaccggacgauguggacuguuggugcaacacaaccucuacgugggucguguauggaaccugucaucacaagaaaggcgaggcccggcgcagcagacgggcuguuacacuucccucccauucuacccgcaagcugcaaacaagaagccagaccuggcucgagucccgggaauacacgaagcaccugauccgcguggagaauuggaucuuuagaaacccuggcuucgcccuggcggccgcugccauugcuuggcuccuggggagcucuacaucccagaaagucaucuaucuugugaugauucugcucaucgcccccgcguacagcauucggugcaucggaguuucuaaucgcgauuuuguggaaggcauguccgggggaaccugggucgacguggugcuggagcauggcgggugugucacaguuauggcccaggauaagccuaccguggacauugagcuugugaccacaacggucagcaacauggcugaagugagaucuuacugcuaugaggccuccaucagcgauauggcuuccgacucucggugucccacccaaggagaagccuaccuggacaaacagagcgauacacaguauguuugcaagagaacccucguggaccgcggcuggggcaauggguguggacuguucggcaaagggucccuggucacaugcgccaaguuugcuugcagcaagaaaaugaccggaaagucuauccagccugagaaccucgaauaccggauuaugcuguccgugcacggcagccaacacucugggaugaucguuaaugauacgggacaugagacagacgagaacagagcgaaaguggaaauuaccccgaauagcccccgcgccgaggcuacccuuggcggcuucgggucccugggacucgauugugaaccucggacaggccuggacuuuucugaucuuuauuaccugaccaugaacaauaagcacuggcucguccauaaagagugguuccacgacaucccccugccuuggcacacaggggccgauacgggaacaccccauuggaacaauaaggaagcccugguggaguuuaaagacgcucacgccaagagacagaccgucgugguucucggcagccaggagggggcggugcauaccgcucuggccggcgcccuugaagcugagauggauggagccaagggccgccuguccagcgggcaccucaaaugccggcugaagauggacaaacuuagacugaagggagucucuuauucccucuguacagcugccuucaccuuuacgaaaauuccggcggaaacccugcauggcacagugaccguugaggugcaguacgccgggacagacggaccuugcaagguccccgcucaaauggccguggauaugcagacccugacgccugugggccgccucaucacagcuaaccccguuaucaccgaagggacagagaacagcaagaugaugcuggagcuugaucccccuuucggcgacucuuacauugucaucggagugggcgagaaaaagauuacccaccacuggcaucgguccgggagcaccaucggaaaagccuuugaagcgacagugagaggcgccaagcgcauggcuguccugggggacacggccugggauuucggauccgugggcgggguucucaauucucugggcaaaggcauucaccagaucuucggagcugccuuuaagagccuguucgggggaauguccugguuuucucaaauccuuauuggcacccuccugauguggcuggggcucaacacaaagaauggaagcaucucccugaugugucuugcccugggcggggugcucauuuuccugagcaccgcugucucugcggacgugggcugcuccguugauuuuagcaaaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8963 - RNA, 2365 nt, Artificial Sequence
  KU744693.1 prME-long mRNA Design 3 opt
gggagaaagcuuaccaugagaaucauuaacgcccggaaggagaaaaagcgcagaggcgcugacaccagcguggggaucgucggacugcuccugacaacggccauggcggcugaaguuacccggcgcggcuccgccuacuauauguaccuugauagaaaugacgccggggaggcuauuucuuuccccacaacccugggaaugaacaaaugcuauauccagauuauggaucucggccacaugugugacgccacaaugagcuacgaaugcccuaugcuggaugaggggguggaaccggacgauguggacuguuggugcaauaccacauccaccugggucguguauggaacgugucaucacaagaaaggcgaggcucggcgcucuagacgggccguuacccuucccagccauuccacacgcaagcugcaaaccagaucucagacauggcucgagagccgggaauacaccaagcaccugauccgcguggagaacuggaucuuuagaaauccuggcuucgcgcuggccgcugccgcuauugccuggcuccugggguccagcacgucucagaaagucaucuaucuugugaugauucugcucaucgcgcccgccuacuccauucggugcaucggaguuagcaaccgcgauuuuguggaaggcaugucugggggaacaugggucgacguggugcuggagcauggcgggugugucaccgcuauggcccaggauaagccuacaguugacauugagcuugugaccaccacaguguccaauauggcugaagucagaagcuacugcuaugaggccucuaucuccgauauggccagcgacucccggugucccacgcaaggagaggcuuaccuggacaaacagucugauacccaguaugugugcaagagaacacucguugaccgcggcuggggcaacggguguggacuguucggcaaagggagccuggugaccugcgcgaaguuugccugcuccaagaaaaugacaggaaagagcauccagccugaaaaucucgaauaccggauuaugcugucuguccacggcucccaacacagcgggaugcuugugaacgauaccggacaugagacggacgagaauagagcuaaaguugaaaucacaccgaacucuccccgcgccgaggccacccugggcggcuucgggagccucggacuggauugugaaccucggaccggccuugacuuuuccgaucuguauuaccucacaaugaauaacaagcacuggcuggcucauaaagagugguuccacgacauuccccugccuuggcacgccggggcggcuaccggaacaccccauuggaauaacaaggaagcccucguggaguuuaaagaugcccacgcuaagagacagacggucgugguccugggcucucaggagggggccgugcauaccgcucuugccggcgcgcuggaagccgagauggacggagcuaagggccgccucagcuccgggcaccugaaaugccggcuuaagauggauaaacugagacucaagggaguuagcuauucucuguguacagccgcuuucaccuuuacaaaaaucccggccgaaaccguggacggcacggucaccguggaggggcaguacggaggcacagacgggccuugcaagguucccgcgcaaauggccguggauaugcagacccugacaccugucggccgccucauuaccgcuaaccccgugaucacggaauccacagagaauagcaagaugaugcuggagcuugaucccccuuucggagacucuuacaucgugauuggcguuggggagaaaaagaucacccaucacuggcaccgguccggaagcacaauuggcaaagccuuugaagcuaccgucagaggggccaagcgcauggccgugcugggagacaccgcuugggauuucggcuccgucgggggcgcgcucaacucucugggaaaaggcauccaucagauuaucggggccgcuuucaagagccuguuuggaggcauguccugguucucucaaauccuuauugggacacuccugauguggcugggacucaauacgaagaacggcagcaucucccugaugugucuugcccucgggggcgugcugauuuuucugagcaccgccgugucuggaggcguugggugcuccguggacuucagcaaaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8964 - RNA, 2365 nt, Artificial Sequence
  KY328290.1 prME-long mRNA Design 3 opt
gggagaaagcuuaccaugagaaucauuaacgcccggaaggagaaaaagcgcagaggcaccgacacaagcguggggaucgucggacugcuccugacgaccgcuauggccgcggaaguuacacggcgcggcuccgcuuacuauauguaccuugauagaucugacgccggggaggccauuagcuuccccaccacacugggaaugaauaaaugcuauauccagauuauggaucucggccacaugugugacgcuaccauguccuacgaaugcccuaugcuggaugaggggguggaaccggacgauguggacuguuggugcaacacaaccucuacgugggucguguauggaaccugucaucacaagaaaggcgaggcccggcgcagcagacgggcuguuacacuucccucccauucuacccgcaagcugcaaacaagaagccagaccuggcucgagucccgggaauacacgaagcaccugauccgcguggagaauuggaucuuuagaaacccuggcuucgcccuggcggccgcugccauugcuuggcuccuggggagcucuacaucccagaaagucaucuaucuugugaugauucugcucaucgcccccgcguacagcauucggugcaucggaguuucuaaucgcgauuuuguggaaggcauguccgggggaaccugggucgacguggugcuggagcauggcgggugugucacaguuauggcccaggauaagccuaccguggacauugagcuugugaccacaacggucagcaacauggcugaagugagaucuuacugcuaugaggccuccaucagcgauauggcuuccgacucucggugucccacccaaggagaagccuaccuggacaaacagagcgauacacaguauguuugcaagagaacccucguggaccgcggcuggggcaauggguguggacuguucggcaaagggucccuggucacaugcgccaaguuugcuugcagcaagaaaaugaccggaaagucuauccagccugagaaccucgaauaccggauuaugcuguccgugcacggcagccaacacucugggaugaucguuaaugauacgggacaugagacagacgagaacagagcgaaaguggaaauuaccccgaauagcccccgcgccgaggcuacccuuggcggcuucgggucccugggacucgauugugaaccucggacaggccuggacuuuucugaucuuuauuaccugaccaugaacaauaagcacuggcucguccauaaagagugguuccacgacaucccccugccuuggcacgccggggccgauacaggaacgccccauuggaacaauaaggaagcucugguggaguuuaaagacgcccacgcgaagagacagaccgucgugguucucggcagccaggagggggcugugcauacagcccuggccggcgcucuugaagccgagauggauggagcuaagggccgccuguccagcgggcaccucaaaugccggcugaagauggacaaacuuagacugaagggagucucuuauucccucuguaccgccgcguucacauuuagcaaaauuccggccgaaacccugcauggcacggugaccgaggaaguucaguacgcugggacagacggaccuugcaaggugcccgcccaaauggcugucgauaugcagacccugacaccugugggccgccucaucaccgccaaccccgugaucacggagucuacagagaacuccaagaugaugcuggaacuugaucccccuuucggggacagcuacauuguuaucggcgucggagagaaaaagauuacccaccacuggcaucgguccggcucuacaaucgggaaagcguuugaagccaccgugagaggagcuaagcgcauggccgugcugggcgacaccgcuugggauuucgggagcgucggaggcgcccucaauucccuggggaaaggcauucaccagaucuucggagccgcuuuuaagucucuguucggcgggaugagcugguuuucccaaauccuuauuggaacacuccugauguggcugggccucaacacgaagaaugggagcaucucucugaugugucuugcgcugggaggcgugcucauuuuccuguccaccgccguuagcgcugacguggggugcucugucgauuuuuccaaaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8965 - RNA, 2365 nt, Artificial Sequence
  KX694532.2 prME-long mRNA Design 3 opt
gggagaaagcuuaccaugagaaucauuaacgcccggaaggagaaaaagcgcagaggcaccgacacaagcguggggaucgucggacugcuccugacgaccgcuauggccgcggaaguuacacggcgcggcuccgcuuacuauauguaccuugauagaucugacgccggggaggccauuagcuuccccaccacacugggaaugaauaaaugcuauauccagauuauggaucucggccacaugugugacgcuaccauguccuacgaaugcccuaugcuggaugaggggguggaaccggacgauguggacuguuggugcaacacaaccucuacgugggucguguauggaaccugucaucacaagaaaggcgaggcccggcgcagcagacgggcuguuacacuucccucccauucuacccgcaagcugcaaacaagaagccagaccuggcucgagucccgggaauacacgaagcaccugauccgcguggagaauuggaucuuuagaaacccuggcuucgcccuggcggccgcugccauugcuuggcuccuggggagcucuacaucccagaaagucaucuaucuugugaugauucugcucaucgcccccgcguacagcauucggugcaucggaguuucuaaucgcgauuuuguggaaggcauguccgggggaaccugggucgacguggugcuggagcauggcgggugugucacaguuauggcccaggauaagccuaccguggacauugagcuugugaccacaacggucagcaacauggcugaagugagaucuuacugcuaugaggccuccaucagcgauauggcuuccgacucucggugucccacccaaggagaagccuaccuggacaaacagagcgauacacaguauguuugcaagagaacccucguggaccgcggcuggggcaauggguguggacuguucggcaaagggucccuggucacaugcgccaaguuugcuugcagcaagaaaaugaccggaaagucuauccagccugagaaccucgaauaccggauuaugcuguccgugcacggcagccaacacucugggaugaucguuaaugauacgggacaugagacagacgagaacagagcgaaaguggaaauuaccccgaauagcccccgcgccgaggcuacccuuggcggcuucgggucccugggacucgauugugaaccucggacaggccuggacuuuucugaucuuuauuaccugaccaugaacaauaagcacuggcucguccauaaagagugguuccacgacaucccccugccuuggcacgccggggccgauacaggaacgccccauuggaacaauaaggaagcucugguggaguuuaaagacgcccacgcgaagagacagaccgucgugguucucggcagccaggagggggcugugcauacagcccuggccggcgcucuugaagccgagauggauggagcuaagggccgccuguccagcgggcaccucaaaugccggcugaagauggacaaacuuagacugaagggagucucuuauucccucuguaccgccgcguucacauuuaccaaaauuccggccgaaacgcugcauggcaccgugacaguugaggugcaguacgcugggaccgacggaccuugcaagguccccgcccaaauggcuguggauaugcagacacugaccccugugggccgccucaucacggccaaccccguuaucacagaaagcaccgagaacucuaagaugaugcuggagcuugaucccccuuucggggacuccuacauugucaucggcgugggagagaaaaagauuacacaccacuggcaucggagcggcuccaccaucgggaaagcguuugaagccaccgugagaggagcuaagcgcauggccguccugggcgacacagcuugggauuucgggucugugggaggcgcccucaauagccuggggaaaggcauucaccagaucuucggagccgcuuuuaagucccuguucggcgggaugucuugguuuagccaaauccuuauuggaacgcuccugauguggcugggccucaacaccaagaauggguccaucagccugaugugucuugcgcugggaggcguucucauuuuccugucuacagccguguccgcugacgucgggugcagcguggauuuuucuaaaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8966 - RNA, 2365 nt, Artificial Sequence
  KU955593.1 prME-long mRNA Design 3 opt
gggagaaagcuuaccaugagaaucauuaacgcccggaaggagaaaaagcgcagaggcaccgacacaagcguggggaucgucggacugcuccugacgaccgcuauggccguugaagugacacggcgcggcaaugcguacuauauguaccuugauagauccgacgcuggggaggccauuucuuuccccaccacaaugggaaugaacaaaugcuauauccagauuauggaucugggccacaugugugacgccaccaugagcuacgaaugcccuaugcucgaugaggggguggaaccggacgaugucgacuguuggugcaauacaaccuccacgugggugguuuauggaaccugucaucacaagaaaggcgaggcucggcgcucuagacgggccgugacacugcccagccauuccacccgcaaacuucaaacaagaucucagaccuggcuggagagccgggaauacacgaagcaccucauccgcgucgagaacuggaucuuuagaaauccuggcuucgcucuggccgcggccgcuauugccuggcugcucggguccagcacaucucagaaagugaucuaucugguuaugauucuucugaucgcucccgccuacuccauucggugcaucggagugagcaaccgcgauuuugucgaaggcaugucugggggaaccuggguggacgugguccucgagcauggcggguguguuacagugauggcgcaggauaagccuaccguggacauugagcuggucaccacaacgguguccaauauggccgaaguuagaagcuacugcuaugaggcuucuaucuccgauauggccagcgacucccggugucccacccaaggagaggcuuaccuugacaaacagucugauacacaguaugugugcaagagaacccuggucgaccgcggcuggggcaacggguguggacucuucggcaaagggagccuggugacaugcgccaaguuugccugcuccaagaaaaugaccggaaagagcauccagccugaaaaucuggaauaccggauuaugcucucuguucacggcucccaacacagcgggaugaucgugaacgauacgggacaugagacagacgagaauagagcuaaagucgaaauuaccccgaacucuccccgcgcggaggccacccugggcggcuucgggagccuuggacuggauugugaaccucggacaggccucgacuuuuccgaucuguauuaccuuaccaugaauaacaagcacuggcuggugcauaaagagugguuccacgacaucccccucccuuggcacgcuggggccgauacaggaacgccccauuggaauaacaaggaagcccuggucgaguuuaaagacgcucacgccaagagacagaccgugguugugcugggcucucaggagggggcgguccauacagcucucgccggcgcccuggaagcugagauggauggagccaagggccgccuuagcuccgggcaccugaaaugccggcucaagauggacaaacugagacuuaagggagugagcuauucucuguguaccgcugccuucacauuuaccaaaauuccggcggaaacgcuccauggcaccguuacaguggagguccaguacgccgggaccgacggaccuugcaaggugcccgcucaaauggccguggauaugcagacacugaccccuguuggccgccugaucacggcuaaccccgucaucacagaauccaccgagaauagcaagaugaugcucgagcuggaucccccuuucggggacucuuacauugugaucggcgugggagaaaagaagauuacacaccacuggcaucgguccggcagcaccaucgggaaagccuuugaggcgaccgucagaggagccaagcgcauggcugugcuuggcgacacagccugggauuucggguccguuggaggcgcucugaacucucucgggaaaggcauucaccagaucuucggagccgccuuuaagagccuguucggcgggauguccugguuuucucaaauccugauuggaacgcuucucguguggcugggccugaauaccaagaacgggagcaucucccucaugugucuggcucuuggaggcguccugauuuuccucagcacagcggugucugccgacguugggugcuccguggauuuuagcaaaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8967 - RNA, 2365 nt, Artificial Sequence
  KY272987.1 prME-long mRNA Design 3 opt
gggagaaagcuuaccaugagaaucauuaacgcccggaaggagaaaaagcgcagaggcaccgacacaagcguggggaucgucggacugcuccugacgaccgcuauggccgcggaaguuacacggcgcggcuccgcuuacuauauguaccuugauagaucugacgccggggaggccauuagcuuccccaccacacugggaaugaauaaaugcuauauccagauuauggaucucggccacaugugugacgcuaccauguccuacgaaugcccuaugcuggaugaggggguggaaccggacgauguggacuguuggugcaacacaaccucuacgugggucguguauggaaccugucaucacaagaaaggcgaggcccggcgcagcagacgggcuguuacacuucccucccauucuacccgcaagcugcaaacaagaagccagaccuggcucgagucccgggaauacacgaagcaccugauccgcguggagaauuggaucuuuagaaacccuggcuucgcccuggcggccgcugccauugcuuggcuccuggggagcucuacaucccagaaagucaucuaucuugugaugauucugcucaucgcccccgcguacagcauucggugcaucggaguuucuaaucgcgauuuuguggaaggcauguccgggggaaccugggucgacguggugcuggagcauggcgggugugucacaguuauggcccaggauaagccuaccguggacauugagcuugugaccacaacggucagcaacauggcugaagugagaucuuacugcuaugaggccuccaucagcgauauggcuuccgacucucggugucccacccaaggagaagccuaccuggacaaacagagcgauacacaguauguuugcaagagaacccucguggaccgcggcuggggcaauggguguggacuguucggcaaagggucccuggucacaugcgccaaguuugcuugcagcaagaaaaugaccggaaagucuauccagccugagaaccucgaauaccggauuaugcuguccgugcacggcagccaacacucugggaugaucguuaaugauacgggacaugagacagacgagaacagagcgaaaguggaaauuaccccgaauagcccccgcgccgaggcuacccuuggcggcuucgggucccugggacucgauugugaaccucggacaggccuggacuuuucugaucuuuauuaccugaccaugaacaauaagcacuggcucguccauaaagagugguuccacgacaucccccugccuuggcacgccggggccgauacaggaacgccccauuggaacaauaaggaagcucugguggaguuuaaagacgcccacgcgaagagacagaccgucgugguucucggcagccaggagggggcugugcauacagcccuggccggcgcucuugaagccgagauggauggagcuaagggccgccuguccagcgggcaccucaaaugccggcugaagauggacaaacuuagacugaagggagucucuuauucccucuguaccgccgcguucacauuuaccaaaauuccggccgaaacgcugcauggcaccgugacaguugaggugcaguacgcugggaccgacggaccuugcaagguccccgcccaaauggcuguggauaugcagacacugaccccugugggccgccucaucacggccaaccccguuaucacagaaagcaccgagaacucuaagaugaugcuggagcuugaucccccuuucggggacuccuacauugucaucggcgugggagagaaaaagauuacacaccacuggcaucggagcggcuccaccaucgggaaagcguuugaagccaccgugagaggagcuaagcgcauggccguccugggcgacacagcuugggauuucgggucugugggaggcgcccucaauagccuggggaaaggcauucaccagaucuucggagccgcuuuuaagucccuguucggcgggaugucuugguuuagccaaauccuuauuggaacgcuccugauguggcugggccucaacaccaagaauggguccaucagccugguuugucuugcgcugggaggcgugcucauuuuccugucuacagccgucuccgcugacguggggugcagcguugauuuuucuaaaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8968 - RNA, 2365 nt, Artificial Sequence
  EU545988.1 prME-long mRNA Design 3 opt
gggagaaagcuuaccaugagaaucauuaacgcccggaaggagaaaaagcgcagaggcaccgacacaagcguggggaucgucggacugcuccugacgaccgcuauggccguugaagugacacggcgcggcuccgcguacuauauguaccuugauagaucugacgcuggggaggccauuagcuuccccaccacacugggaaugaauaaaugcuauauccagauuauggaucucggccacaugugugacgccaccauguccuacgaaugcccuaugcuggaugaggggguggaaccggacgaugucgacuguuggugcaacacaaccucuacgugggugguuuauggaaccugucaucacaagaaaggcgaggcucggcgcagcagacgggccgugacacuucccucccauucuacccgcaagcugcaaacaagaagccagaccuggcucgagucccgggaauacacgaagcaccugauccgcgucgagaauuggaucuuuagaaacccuggcuucgcucuggccgcggccgcuauugccuggcuccuggggagcucuacaucccagaaagugaucuaucuuguuaugauucugcucaucgcucccgccuacagcauucggugcaucggagugucuaaucgcgauuuugucgaaggcauguccgggggaaccuggguggacgugguccuggagcauggcggguguguuacagugauggcgcaggauaagccugccguggacauugagcuugucaccaccacagugagcaacauggcugaaguuagaucuuacugcuaugaggccuccaucagcgauauggcuuccgacucucggugucccacgcaaggagaagccuaccuggacaaacagagcgauacccaguaugugugcaagagaacacucgucgaccgcggcuggggcaauggguguggacuguucggcaaagggucccuggugaccugcgccaaguuugcuugcagcaagaaaaugacaggaaagucuauccagccugagaaccucgaauaccggauuaugcuguccguucacggcagccaacacucugggaugaucgugaaugauaccggacaugagacggacgagaacagagcgaaagucgaaauuacaccgaauagcccccgcgccgaggcuacccuuggcggcuucgggucccugggacucgauugugaaccucggaccggccuggacuuuucugaucuuuauuaccugacaaugaacaauaagcacuggcucgugcauaaagagugguuccacgacaucccccugccuuggcacgccggggccgauaccggaacaccccauuggaacaauaaggaagcucuggucgaguuuaaagacgcccacgcgaagagacagacggugguugugcucggcagccaggagggggcuguccauaccgcccuggccggcgcucuugaagccgagauggauggagcuaagggccgccuguccagcgggcaccucaaaugccggcugaagauggacaaacuuagacugaagggagugucuuauucccucuguacagccgcguucaccuuuacaaaaauuccggccgaaacccugcauggcacgguuaccguggagguccaguacgcugggacagacggaccuugcaaggugcccgcccaaauggcuguggauaugcagacccugacaccuguuggccgccucaucaccgccaaccccgucaucacggaaagcacagagaacucuaagaugaugcuggagcuugaucccccuuucggggacuccuacauugugaucggcgugggagagaaaaagauuacccaccacuggcaucggagcggcuccacaaucgggaaagcguuugaagccaccgucagaggagcuaagcgcauggccgugcugggcgacaccgcuugggauuucgggucuguuggaggcgcccucaauagccuggggaaaggcauucaccagaucuucggagccgcuuuuaagucccuguucggcgggaugucuugguuuagccaaauccuuauuggaacacuccugguguggcugggccucaacacgaagaauggguccaucagccugaccugucuugcgcugggaggcguccucauuuuccugucuacagccguguccgcugacguugggugcagcguggauuuuucuaaaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8969 - RNA, 2365 nt, Artificial Sequence
  KU681082.3 prME-long mRNA Design 3 opt
gggagaaagcuuaccaugagaaucauuaacgcccggaaggagaaaaagcgcagaggcgcugacaccagcguggggaucgucggacugcuccugacaacggccauggcgguugaagugacccggcgcggcuccgcuuacuauauguaccuugauagaucugacgccggggaggccauuagcuuccccacaacccugggaaugaauaaaugcuauauccagauuauggaucucggccacaugugugacgcuacaauguccuacgaaugcccuaugcuggaugaggggguggaaccggacgaugucgacuguuggugcaacaccacaucuaccugggugguuuauggaacgugucaucacaagaaaggcgaggcccggcgcagcagacgggcugugacccuucccucccauucuacacgcaagcugcaaaccagaagccagacauggcucgagucccgggaauacaccaagcaccugauccgcgucgagaauuggaucuuuagaaacccuggcuucgcccuggcggccgcugugauugccuggcuccuggggagcucuacgucccagaaaguuaucuaucuugugaugauucugcucaucgcucccgccuacagcauucggugcaucggagucucuaaucgcgauuuuguggaaggcauguccgggggaacauggguggacgucguucuggagcauggcgggugugugaccgugauggcgcaggauaagccuacagucgacauugagcuugugaccaccacaguuagcaacauggccgaagugagaucuuacugcuaugaggcuuccaucagcgauauggccuccgacucucggugucccacgcaaggagaggcuuaccuggacaaacagagcgauacccaguaugucugcaagagaacacucguggaccgcggcuggggcaauggguguggacuguucggcaaagggucccugguuaccugcgccaaguuugccugcagcaagaaaaugacaggaaagucuauccagccugaaaaccucgaauaccggauuaugcuguccgugcacggcagccaacacucugggaugaucgucaaugauaccggacaugagacggacgagaacagagcuaaaguggaaauuacaccgaauagcccccgcgcggaggccacccuuggcggcuucgggucccugggacucgauugugaaccucggaccggccuggacuuuucugaucuuuauuaccugacaaugaacaauaagcacuggcucguccauaaagagugguuccacgacaucccccugccuuggcacgcuggggccgauaccggaacaccccauuggaacaauaaggaagcccugguggaguuuaaagacgcucacgccaagagacagacgguugugguccucggcagccaggagggggcggugcauaccgcucuggccggcgcccuugaagcugagauggauggagccaagggccgccuguccagcgggcaccucaaaugccggcugaagauggacaaacuuagacugaagggaguuucuuauucccucuguacagcugccuucaccuuuacaaaaauuccggcggaaacccugcauggcacggugaccgucgaggugcaguacgccgggacagacggaccuugcaaggugcccgcucaaauggccguugauaugcagacccugacaccugucggccgccucaucaccgcuaaccccgugaucacggaaagcacagagaacucuaagaugaugcuggagcuugaucccccuuucggggacuccuacauugugaucggcgucggagagaaaaagauuacccaccacuggcaucggagcggcuccacaaucgggaaagccuuugaagcgaccgugagaggagccaagcgcauggcuguucugggcgacaccgccugggauuucgggucugugggaggcgcucucaauagccuggggaaaggcauucaccagaucuucggagccgccuuuaagucccuguucggcgggaugucuugguuuagccaaauccuuauuggaacacuccuggucuggcugggccucaacacgaagaauggguccaucagccugaccugucuugcucugggaggcgugcucauuuuccugucuacagcgguuuccgccgacguggggugcagcgucgauuuuucuaaaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8970 - RNA, 2365 nt, Artificial Sequence
  KX601167.1 prME-long mRNA Design 3 opt
gggagaaagcuuaccaugagaaucauuaacgcccggaaggagaaaaagcgcagaggcgcugacaccagcguggggaucgucggacugcuccugacaacggccauggcgguugaagugacccggcgcggcuccgcuuacuauauguaccuugauagaucugacgccggggaggccauuagcuuccccacaacccugggagugaauaaaugcuauauccagauuauggaucucggccacaugugugacgcuacaauguccuacgaaugcccuaugcuggaugagggggucgaaccggacgauguggacuguuggugcaacaccacaucuaccuggguuguguauggaacgugucaucacaagaaaggcgaggcccggcgcagcagacgggcugucacccuucccucccauucuacacgcaagcugcaaaccagaagccagacauggcucgagucccgggaauacaccaagcaccugauccgcguggagaauuggaucuuuagaaacccuggcuucgcccuggcggccgcugccauugcuuggcuccuggggagcucuacgucccagaaaguuaucuaucuugugaugauucugcucaucgcccccgcguacagcauucggugcaucggagucucuaaucgcgauuuuguggaaggcauguccgggggaacauggguggacgucguucuggagcauggcgggugugugaccgugauggcccaggauaagccuacagucgacauugagcuugugaccaccacaguuagcaacauggcugaagugagaucuuacugcuaugaggccuccaucagcgauauggcuuccgacucucggugucccacgcaaggagaagccuaccuggacaaacagagcgauacccaguaugucugcaagagaacacucguggaccgcggcuggggcaauggguguggacuguucggcaaagggucccugguuaccugcgccaaguuugcuugcagcaagaaaaugacaggaaagucuauccagccugagaaccucgaauaccggauuaugcuguccgugcacggcagccaacacucugggaugaucgucaaugauaccggacaugagacggacgagaacagagcgaaaguggaaauuacaccgaauagcccccgcgccgaggcuacccuuggcggcuucgggucccugggacucgauugugaaccucggaccggccuggacuuuucugaucuuuauuaccugacaaugaacaauaagcacuggcucguccauaaagagugguuccacgacaucccccugccuuggcacgccggggccgauaccggaacaccccauuggaacaauaaggaagcucugguggaguuuaaagacgcccacgcgaagagacagacgguugugguccucggcagccaggagggggcugugcauaccgcccuggccggcgcucuugaagccgagauggauggagcuaagggccgccuguccagcgggcaccucaaaugccggcugaagauggacaaacuuagacugaagggaguuucuuauucccucuguacagccgcguucaccuuuacaaaaauuccggccgaaacccugcauggcacggugaccgucgaggugcaguacgcugggacagacggaccuugcaaggugcccgcccaaauggcuguugauaugcagacccugacaccugucggccgccucaucaccgccaaccccgugaucacggaaagcacagagaacucuaagaugaugcuggagcuugaucccccuuucggggacuccuacauugugaucggcgucggagacaaaaagauuacccaccacugguaucggagcggcuccacaaucgggaaagcguuugaagccaccgugagaggagcuaagcgcauggccguucugggcgauaccgcuugggacuucgggucugugggaggcgcccucaauagccuggggaaaggcauucaucagaucuucggagccgcuuuuaagucccuguucggcgggaugucuugguuuagccaaauccuuauuggaacacuccuggucuggcugggccucaacacgaagaauggguccaucagccugaccugucuugcgcugggaggcgugcucauuuuccugucuacagccguuuccgcugauguggggugcagcgucgacuuuucuaaaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8971 - RNA, 2365 nt, Artificial Sequence
  KX694533.2 prME-long mRNA Design 3 opt
gggagaaagcuuaccaugagaaucauuaacgcccggaaggagaaaaagcgcagaggcgcugacaccagcguggggaucgucggacugcuccugacaacggccauggcgguugaagugacccggcgcggcuccgcuuacuauauguaccuugauagaucugacgccgggaaagccauuagcuuccccacaacccugggagugaauaagugcuauauccagauuauggaucucggccacaugugugacgcuacaauguccuacgagugcccuaugcuggaugaaggggucgagccggacgauguggacuguuggugcaacaccacaucuaccuggguuguguauggaacgugucaucacaaaaagggcgaagcccggcgcagcagacgggcugucacccuucccucccauucuacacgcaagcugcaaaccagaagccagacauggcucgagucccgggaguacaccaaacaccugauccgcguggaaaauuggaucuuuagaaacccuggcuucgcccuggcggccgcugccauugcuuggcuccuggggagcucuacgucccagaagguuaucuaucuugugaugauucugcucaucgcccccgcguacagcauucggugcaucggagucucuaaucgcgauuuuguggagggcauguccgggggaacauggguggacgucguucuggaacauggcgggugugugaccgugauggcccaggauaaaccuacagucgacauugagcuugugaccaccacaguuagcaacauggcugaggugagaucuuacugcuaugaagccuccaucagcgauauggcuuccgacucucggugucccacgcaaggagaggccuaccuggacaagcagagcgauacccaguaugucugcaaaagaacacucguggaccgcggcuggggcaauggguguggacuguucggcaaggggucccugguuaccugcgccaaguuugcuugcagcaaaaagaugacaggaaaaucuauccagccugaaaaccucgaguaccggauuaugcuguccgugcacggcagccaacacucugggaugaucgucaaugauauuggacaugaaaccgacgagaacagagcgaagguggagaucacgccgaauagcccccgcgccgaagcuacacuuggcggcuucgggucccugggacucgauugugagccucggaccggccuggacuuuucugaucuuuauuaccugaccaugaacaauaaacacuggcucguccauaaggaaugguuccacgacauuccccugccuuggcacgccggggccgauacaggaacaccccauuggaacaauaaagaggcucugguggaauuuaaggacgcccacgcgaagagacagacaguugugguccucggcagccaggagggggcugugcauacggcccuggccggcgcucuugaggccgaaauggauggagcuaaaggccgccuguccagcgggcaccucaagugccggcugaaaauggacaaacuuagacugaagggaguuucuuauucccucuguaccgccgcguucacauuuaccaagaucccggccgagacacugcauggcaccgugacggucgaagugcaguacgcugggaccgacggaccuugcaaggugcccgcccaaauggcuguugauaugcagacacugaccccugucggccgccucaucacagccaaccccgugauuaccgagagcacggaaaacucuaaaaugaugcuggagcuugaucccccuuucggggacuccuacaucgugauuggcgucggagacaagaaaaucacacaccacuggcaucggagcggcuccaccauugggaaggcguuugaggccacagugagaggagcuaaacgcauggccguucugggcgauaccgcuugggacuucgggucugugggaggcgcccucaauagccuggggaagggcauccaccagaucuucggagccgcuuuuaagucccuguucggcgggaugucuugguuuagccaaauucuuaucggaacccuccuggucuggcugggccucaacaccaaaaauggguccauuagccugacgugucuugcgcugggaggcgugcucaucuuccugucuaccgccguuuccgcugauguggggugcagcgucgacuuuucuaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8972 - RNA, 2365 nt, Artificial Sequence
  KY288905.1 prME-long mRNA Design 3 opt
gggagaaagcuuaccaugagaaucauuaacgcccggaaggagcgcaaaagacggggcgcugacaccagcaucgggauugugggacugcuccugacaacggccauggcggcugaaaucacccgcagaggcuccgccuacuauauguaccuugaucggucugacgccgggaaggcuauuagcuucgccacaacccugggagucaauaaaugccacguucagaucauggaucucggccauaugugugacgcuacaauguccuaugagugccccaugcuggaugaagggguggagcccgacgauguggacuguuggugcaacaccacaucuaccugggucguguacggaacgugucaccauaagaaaggcgaagcccgcagaagccggcgcgcgguuacccuuccgucccacucuacaagaaagcugcaaacccggagccagacauggcucgagucccgcgaguauaccaagcaucugaucaaaguggaaaauuggauuuuuagaaaccccggcuucacgcuggucgccguggcuaucgccuggcuccuggggagcucuacaucccagaagguuauuuaccuugugaugauccugcucauugcuccugccuauagcauccggugcauuggagucucuaaucgcgauuuuguggagggcauguccgggggaaccuggguggacgucguucuggaacacggcgggugugugacagugauggcgcaggauaaacccaccgucgacaucgagcuugugaccacaacgguuagcaacauggccgaggugagaucuuacugcuacgaagccuccaucagcgauauggcuuccgacucucgguguccuacccaaggagaggcuuaucuggacaagcagagcgauacacaguacgucugcaaaagaacccucguggaccgcggcuggggcaauggguguggacuguucggcaaggggucccugguuacaugcgccaaguuuaccugcagcaaaaagaugacgggaaaaucuauucagcccgaaaaccucgaguaucggaucaugcuguccgugcacggcagccaacauucugggaugauugucaaugauacaggacacgaaaccgacgagaacagagccaagguggaggucaccccuaauagcccgcgcgcugaagcgacacuuggcggcuucgggucccugggacucgauugugagccccggaccggccuggacuuuucugaucuuuacuaucugacaaugaacaauaaacauuggcucgugcacaaggaaugguuccacgacaucccucugcccuggcaugccggggcugauacgggaaccccucacuggaacaauaaagaggcccugguugaauuuaaggacgcccaugcuaagagacagacaguggucgugcucggcagccaggagggggccguucacaccgcgcuggcuggcgcccuugaggccgaaauggauggagcuaaaggccgccuguucuccgggcaucucaagugccggcugaaaauggacaaacuuagacugaaaggagugagcuacucucucuguacagccgcuuuuaccuucacgaagguccccgccgagacccugcacggcacagugaccguggaaguucaguaugcggggacagacggaccgugcaaggucccugcccaaauggcuguggauaugcagacccugacgcccgugggccgccucauuacagccaacccugucaucaccgaguccacagaaaacagcaaaaugaugcuggagcuugacccucccuuuggggauucuuacaucgugauuggcguuggagacaagaaaaucacccaccauuggcaccgguccggcagcaccauugggaaggcuuucgaggccacagugagaggagcgaaacgcauggccguccugggcgauacggcuugggacuucggguccgugggaggcguuuuuaauucucucgggaagggcauccaucagauuuucggagccgcuuuuaagagccuguucggcgggauguccugguuuucucaaauccugaucggaacccuucucguguggcugggccugaacacaaagaaugggagcauuucccucaccugucuggcccuuggaggcgucaugaucuuccugagcacagccgugucugcugauguugggugcuccguggacuuuagcaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8973 - RNA, 2365 nt, Artificial Sequence
  KF268950.1 prME-long mRNA Design 3 opt
gggagaaagcuuaccaugagaaucauuaacgcccggaaggagcgcaaaagacggggcgcugacaccagcaucgggauuaucggacugcuccugacaacggccauggcggcugaaauuacccgcagaggcuccgccuacuauauguaccuugaucggucugacgccgggaaggcuaucagcuucgccacaaaucugggagugaacaaaugccacguccagaucauggaucucggccauaugugugacgcuaccauguccuaugagugccccaugcuggaugaagggguugagcccgacgauguggacuguuggugcaauacaaccucuacauggguggucuacggaaccugucaccauaagaaaggcgaagcccgcagaagccggcgcgcggugacgcuuccgucccacucuaccagaaagcugcaaacacggagccagaccuggcucgagucccgcgaguauacaaagcaucugauuaaaguugaaaacuggaucuuuagaaaucccggcuucgcccuggcugccguggcuauugccuggcuccuggggagcucuaccucccagaaggucaucuaccuugugaugauucugcucaucgcgccugccuauagcauucggugcaucggaguuucuaaccgcgauuuuguggagggcauguccgggggaacgugggucgacguggugcuggaacacggcgggugugucacaguuauggcucaggauaaacccaccguggacaucgagcuugugacaaccaccgucagcaauauggccgaggugagaucuuacugcuacgaggcuuccauuagcgauauggccuccgacucucgguguccuacacaaggagaagccuaucuggacaagcagagcgauacgcaguacguuugcaaaagaacccucguggaccgcggcuggggcaacggguguggacuguucggcaaggggucccuggucacaugcgcuaaguuuaccugcagcaaaaagaugacaggaaaaucuauccagcccgaaaaucucgaguaucggauuaugcuguccgugcacggcagccaacauucugggaugaucguuaacgauauuggacacgaaaccgacgagaauagagcgaagguggaggucacgccuaacagcccgcgcgccgaagcuacacuuggcggcuucgggucccugggacucgauugugagccccggaccggccuggacuuuucugaucuuuacuaucugaccaugaauaacaaacauuggcucgugcacaaggaaugguuccacgacaucccucugcccuggcaugccggggccgauacaggaaccccucacuggaauaacaaagaggcucuggucgaauuuaaggacgcccaugcgaagagacagacagugguugugcucggcagccaggagggggcuguccacacggcccuggccggcgcucuugaggccgaaauggauggagcuaaaggccgccuguucuccgggcaucucaagugccggcugaaaauggacaaacuuagacugaaaggagugagcuacucucucuguaccgccgcguuuacauucaccaagguucccgccgagacacugcacggcaccgugacggucgaagugcaguaugcugggaccgacggaccgugcaaggugccugcccaaauggcuguugauaugcagacacugacccccgucggccgccucaucacagccaacccugugauuaccgaguccacggaaaauagcaaaaugaugcuggagcuugacccucccuuuggggauucuuacaucgugauuggcgucggagacaagaaaaucacacaccauuggcaccgguccggcagcaccauugggaaggcguucgaggccacagugagaggagcuaaacgcauggccguucugggcgauaccgcuugggacuucggguccgugggaggcgucuuuaacucucucgggaagggcgugcaucagaucuucggagccgccuuuaagagccuguucggcgggauguccugguuuucucaaauccugauuggaacccuucucguuuggcugggccugaauacaaagaacgggagcaucucccucacgugucuggcucuuggaggcgugaugauuuuccugagcaccgcggucucugccgauguggggugcuccguugacuuuagcaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8974 - RNA, 2365 nt, Artificial Sequence
  KF383121.1 prME-long mRNA Design 3 opt
gggagaaagcuuaccaugagaaucauuaacgcccggaaggagcgcaaaagacggggcgcugacaccagcaucgggauuaucggacugcuccugacaacggccauggcggcugaaauuacccgcagaggcuccgccuacuauauguaccuugaucggucugacgccgggaaggcuaucagcuucgccacaacccugggagugaauaaaugccacguccagaucauggaucucggccauaugugugacgcuacaauguccuaugagugccccaugcuggaugaagggguugagcccgacgauguggacuguuggugcaacaccacaucuaccuggguggucuacggaacgugucaccauaagaaaggcgaagcccgcagaagccggcgcgcggugacccuuccgucccacucuacaagaaagcugcaaacccggagccagacauggcucgagucccgcgaguauaccaagcaucugauuaaaguugaaaauuggaucuuuagaaaccccggcuucgcccugguggcugucgccauugcuuggcuccuggggagcucuacgucccagaaggugaucuaccuuguuaugauucugcucaucgccccugcguauagcauucggugcaucggagugucuaaucgcgauuuugucgagggcauguccgggggaacauggguggacgugguccuggaacacggcggguguguuaccgugauggcccaggauaaacccacaguggacaucgagcuugucaccaccacagugagcaacauggcugagguuagaucuuacugcuacgaagccuccauuagcgauauggcuuccgacucucgguguccuacgcaaggagaggccuaucuggacaagcagagcgauacccaguacgugugcaaaagaacacucgucgaccgcggcuggggcaauggguguggacuguucggcaaggggucccuggugaccugcgccaaguuuacaugcagcaaaaagaugaccggaaaaucuauccagcccgaaaaccucgaguaucggauuaugcuguccguucacggcagccaacauucugggaugaucgugaaugauauuggacacgaaacggacgagaacagagcuaaggucgaggugacaccuaauagcccgcgcgcggaagccacccuuggcggcuucgggucccugggacucgauugugagccccggaccggccuggacuuuucugaucuuuacuaucugacaaugaacaauaaacauuggcucguccacaaggaaugguuccacgacaucccucugcccuggcaugcuggggccgauaccggaacaccucacuggaacaauaaagaggcccugguggaauuuaaggacgcucaugccaagagacagacgguugugguccucggcagccaggagggggcggugcacaccgcucuggccggcgcccuugaggcugaaauggauggagccaaaggccgccuguucuccgggcaucucaagugccggcugaaaauggacaaacuuagacugaagggaguuagcuacucucucuguacagcugccuuuaccuucacaaaggugcccgcggagacccugcacggcacggucaccguggaagugcaguaugccgggacagacggaccgugcaagguuccugcucaaauggccgucgauaugcagacccugacacccgugggccgccucaucaccgcuaacccugugauuacggaguccacagaaaacagcaaaaugaugcuggagcuugacccucccuuuggggauucuuacaucgucauuggcgugggagacaagaaaaucacccaccauuggcaccgguccggcagcacaauugggaaggccuucgaggcgaccguuagaggagccaaacgcauggcugugcugggcgauaccgccugggacuucggguccgucggaggcguguuuaauucucucgggaagggcauccaucagaucuucggagcugccuuuaagagccuguucggcgggauguccugguuuucucaaauucugaucggaacacuucucguuuggcugggccugaacacgaaaaaugggagcauuucccucaccugucuggcccuuggaggcgugaugaucuuccugagcacagcugucucugcggauguggggugcuccguugacuuuagcaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8975 - RNA, 2347 nt, Artificial Sequence
  KF268949.1 prME-long mRNA Design 3 opt
gggagaaagcuuaccaugagaaucauuaacgcccggaaggagcgcaaaagacggggcgcugacaccagcaucgggauuaucggacugcuccugacaacggccauggcggcugaaauuacccgcagaggcuccgccuacuauauguaccuugaucggucugacgccgggaaggcuaucagcuucgccacaaaucugggagugaacaaaugccacguccagaucauggaucucggccauaugugugacgcuaccauguccuaugagugccccaugcuggaugaagggguugagcccgacgauguggacuguuggugcaauacaaccucuacauggguggucuacggaaccugucaccauaagaaaggcgaagcccgcagaagccggcgcgcggugacgcuuccgucccacucuaccagaaagcugcaaacacggagccagaccuggcucgagucccgcgaguauacaaagcaucugauuaaaguugaaaacuggaucuuuagaaaucccggcuucgcccuggcugccguggcuauugccuggcuccuggggagcucuaccucccagaaggucaucuaccuugugaugauucugcucaucgcgccugccuauagcauucggugcaucggaguuucuaaccgcgauuuuguggagggcauguccgggggaacgugggucgacguggugcuggaacacggcgggugugucacaguuauggcucaggauaaacccaccguggacaucgagcuugugacaaccaccgucagcaauauggccgaggugagaucuuacugcuacgaggcuuccauuagcgauauggccuccgacucucgguguccuacacaaggagaagccuaucuggacaagcagagcgauacgcaguacguuugcaaaagaacccucguggaccgcggcuggggcaacggguguggacuguucggcaaggggucccuggucacaugcgcuaaguuuaccugcagcaaaaagaugacaggaaaaucuauccagcccgaaaaucucgaguaucggauuaugcuguccgugcacggcagccaacauucugggaugaucguuaacgaugaaaauagagcgaagguggaggucaccccuaacagcccgcgcgccgaggcuacgcuuggaggcuucggcucccuggggcucgacugugaaccccggacaggacuggauuuuucugaccuuuacuaucugaccaugaauaacaaacacuggcucgugcauaaggagugguuccacgauauuccucugcccuggcacgccggcgccgacaccgggacaccucauuggaauaacaaagaagcucuggucgaguuuaaggaugcccacgcgaagagacagaccgugguugugcucggaagccaggaaggcgcuguccauacagcccuggccggggcucuugaggccgagauggacggcgcuaaaggacgccuguucuccggccaccucaagugccggcugaaaauggauaaacuuagacugaagggggugagcuacucucucuguacggccgcguuuaccuucacaaagguucccgccgaaacccugcauggaacagugaccgucgaggugcaguaugcuggcacggacgggccgugcaaggugccugcccaaauggcuguugacaugcagacccugacacccgucggacgccucaucaccgccaacccugugaucacagaauccaccgagaauagcaaaaugaugcuggaacuugauccucccuuuggcgacucuuacauugugaucggggucggcgauaagaaaauuacgcaccacuggcaucgguccggaagcacaaucggcaaggcguucgaggccaccgugagaggggcuaaacgcauggccguucugggagacacagcuugggauuucggcuccgucgggggaguguuuaacucucucggcaaggggauucaccagaucuucggcgccgccuuuaagagccuguucggaggcauguccugguuuucucaaauccugauugggacccuucucguguggcugggacugaauaccaaaaacggcagcaucucccucacaugucuggcucuugggggaguuaugauuuuccugagcacggcggugucugccgacgucggcugcuccguggauuuuagcaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8976 - RNA, 2365 nt, Artificial Sequence
  KU955595.1 prME-long mRNA Design 3 opt
gggagaaagcuuaccaugagaaucauuaacgcccggaaggagcgcaaaagacggggcgcugacaccagcaucgggauugugggacugcuccugacaacggccauggcggcugaaaucacccgcagaggcuccgccuacuauauguaccuugaucggucugacgccgggaaggcuauuagcuucgccacaacccugggagucaauaaaugccacguucagaucauggaucucggccauaugugugacgcuacaauguccuaugagugccccaugcuggaugaagggguggagcccgacgauguggacuguuggugcaacaccacaucuaccugggucguguacggaacgugucaccauaagaaaggcgaagcccgcagaagccggcgcgcgguuacccuuccgucccacucuacaagaaagcugcaaacccggagccagacauggcucgagucccgcgaguauaccaagcaucugaucaaaguggaaaauuggauuuuuagaaaccccggcuucgcccuggucgcuguggccaucgcuuggcuccuggggagcucuacgucccagaagguuauuuaccuugugaugauccugcucauugccccugcguauagcauccggugcauuggagucucuaaucgcgauuuuguggagggcauguccgggggaacauggguggacgucguucuggaacacggcgggugugugaccgugauggcccaggauaaacccacagucgacaucgagcuugugaccaccacaguuagcaacauggcugaggugagaucuuacugcuacgaagccuccaucagcgauauggcuuccgacucucgguguccuacgcaaggagaggccuaucuggacaagcagagcgauacccaguacgucugcaaaagaacacucguggaccgcggcuggggcaauggguguggacuguucggcaaggggucccugguuaccugcgccaaguuuacaugcagcaaaaagaugaccggaaaaucuauucagcccgaaaaccucgaguaucggaucaugcuguccgugcacggcagccaacauucugggaugauugucaaugauacgggacacgaaacagacgagaacagagcuaagguggaggucaccccuaauagcccgcgcgcggaagccacccuuggcggcuucgggucccugggacucgauugugagccccggacaggccuggacuuuucugaucuuuacuaucugaccaugaacaauaaacauuggcucgugcacaaggaaugguuccacgacaucccucugcccuggcaugcuggggccgauacaggaacgccucacuggaacaauaaagaggcccugguugaauuuaaggacgcucaugccaagagacagaccguggucgugcucggcagccaggagggggcgguucacacagcucuggccggcgcccuugaggcugaaauggauggagccaaaggccgccuguucuccgggcaucucaagugccggcugaaaauggacaaacuuagacugaagggagugagcuacucucucuguaccgcugccuuuacauucaccaagguccccgcggagacgcugcacggcaccgugacaguggaaguucaguaugccgggaccgacggaccgugcaaggucccugcucaaauggccguggauaugcagacacugacccccgugggccgccucauuacggcuaacccugucaucacagaguccaccgaaaacagcaaaaugaugcuggagcuugacccucccuuuggggauucuuacaucgugauuggcguuggagacaagaaaaucacacaccauuggcaccgguccggcagcaccauugggaaggccuucgaggcgaccgugagaggagccaaacgcauggcuguccugggcgauacagccugggacuucggguccgugggaggcguuuuuaauucucucgggaagggcauccaucagauuuucggagcugccuuuaagagccuguucggcgggauguccugguuuucucaaauccugaucggaacgcuucucguguggcugggccugaacaccaaaaaugggagcauuucccucacaugucuggcccuuggaggcgucaugaucuuccugagcaccgcugugucugcggauguugggugcuccguggacuuuagcaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8977 - RNA, 2365 nt, Artificial Sequence
  KF383116.1 prME-long mRNA Design 3 opt
gggagaaagcuuaccaugagaaucauuaacgcccggaaggagcgcaaaagacggggcgcugacaccagcaucgggauugugggacugcuccugacaacggccauggcggcugaaaucacccgcagaggcuccgccuacuauauguaccuugaucggucugacgccgggaaggcuauuagcuucgccacaacccugggagucaauaaaugccacguucagaucauggaucucggccauaugugugacgcuacaauguccuaugagugccccaugcuggaugaagggguggagcccgacgauguggacuguuggugcaacaccacaucuaccugggucguguacggaacgugucaacacaagaaaggcgaagcccgcagaagccggcgcgcgguuacccuuccgucccauucuacaagaaagcugcagacccggagccagacauggcucgagucccgcgaguauaccaagcaccugaucaaaguggaaaauuggauuuuuagaaaccccggcuucgcccuggucgcuguggccaucgcuuggcuccuggggagcucuacgucccagaagguuauuuaccuugugaugauccugcucauugccccugcguauagcauccggugcauuggagucucuaaucgcgauuuuguggagggcauguccgggggaacauggguggacgucguucuggaacauggcgggugugugaccgugauggcccaagauaaacccacagucgacaucgagcuugugaccaccacaguuagcaacauggcugaggugagaucuuacugcuacgaagccuccaucagcgauauggcuuccgacucucgguguccuacgcagggagaggccuaucuggacaagcagagcgauacccaguacgucugcaaaagaacacucguggaccgcggcuggggcaauggguguggacuguucggcaaggggucccugguuaccugcgccaaguuuacaugcagcaaaaagaugaccggaaaaucuauucaacccgaaaaccucgaguaucggaucaugcuguccgugcacggcagccagcacucugggaugauugucaaugauaucggacaugaaacggacgagaacagagcuaagguggaggucacaccuaauagcccgcgcgcggaagccacccuuggcggcuucgggucccugggacucgauugugagccccggaccggccuggacuuuucugaucuuuacuaucugacaaugaacaauaaacacuggcucgugcauaaggaaugguuccacgacauuccucugcccuggcacgcuggggccgauaccggaacaccucauuggaacaauaaagaggcccugguugaauuuaaggacgcucacgccaagagacagacgguggucgugcucggcagccaggagggggcgguucauaccgcucuggccggcgcccuugaggcugaaauggauggagccaaaggccgccuguucuccgggcaccucaagugccggcugaaaauggacaaacuuagacugaaaggagugagcuacucucucuguacagcugucugcaccgccgcgaaggugcccgccgagacacugcauggcaccgugacgguugaaguccaauaugcugggaccgacggaccguguaaggugccugcccagauggcuguggauaugcagacacugacccccgucggccgccucaucacagccaacccugugaucaccgaguccacggaaaacagcaaaaugaugcuggagcuugacccucccuuuggggauucuuacauuguuaucggcgugggagacaagaaaauuacacaccacuggcaucgguccggcagcaccaucgggaaggcguucgaggccacagucagaggagcuaaacgcauggccgugcugggcgauaccgcuugggacuuuggguccguuggaggcguguucaauucucucgggaagggcauucaccaaaucuucggagccgccuuuaagagccuguucggcgggauguccugguuuucucagauccugauuggaacccuucucgucuggcugggccugaacacaaagaaugggagcaucucccucacgugccuggcucuuggaggcgugaugauuuuccugagcaccgcgguuucugccgaugugggguguuccgucgacuuuagcaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8978 - RNA, 2347 nt, Artificial Sequence
  KU963574.2 prME-long mRNA Design 3 opt
gggagaaagcuuaccaugagaaucauuaacgcccggaaggagcgcaaaagacggggcgcugacgccagcaucgggauugugucccugcuccugaccacagucauggcggcugaaaucacgcgcagaggaucugccuacuauauguaccuugaucggagcgacgccggcaaggcuauuuccuucguuaccacacugggggugaauaaaugccacgugcagaucauggaucucggacauaugugugacgccaccaugucuuaugagugccccaugcuggaugaaggcgucgagcccgacgauguggacuguuggugcaacacaaccagcacauggguuguguacgggaccugucaccauaagaaaggagaagcucgcagaucccggcgcgccgucacgcuuccgucucacagcaccagaaagcugcaaacacggucccagaccuggcucgagagccgcgaguauacaaagcaucugaucaaaguggaaaauuggauuuuuagaaaccccggcuucgcgcugguugccguggcuaucgccuggcuccugggaucuuccaccagccagaaggucauuuaccuugugaugauccugcucauugcuccugccuauucuauccggugcauugggguguccaaucgcgauuuugucgagggaaugagcggcgggacguggguugacguggugcuggaacacggaggcugugucacagugauggcgcaggauaaacccaccguugacaucgagcuugugacaaccaccgucucuaacauggccgaggugagauccuacugcuacgaagcuagcaucuccgauauggccucugacagccgguguccuacacaaggggaggcuuaucuggacaagcaguccgauacgcaguacguuugcaaaagaacccucguggaccgcggauggggcaauggcugugggcuguucggaaagggcagccuggucacaugcgccaaguuuaccugcucuaaaaagaugacagggaaauccauucagcccgaaaaccucgaguaucggaucaugcugagcgugcacggaucucaacauagcggcaugauugucaaugaugaaaacagagccaagguggagguuaccccuaauuccccgcgcgcugaggcgacgcuugggggauucggcucucugggccucgacugugaaccccggacagggcuggauuuuagcgaccuuuacuaucugaccaugaacaauaaacacuggcucgugcauaaggagugguuccacgauaucccucugcccuggcacuccggagccgacaccgaaacaccucauuggaacaauaaagaggcucuggucgaauuuaaggaugcccacgccaagagacagaccgugguugugcucggcagccaggagggggcuguccauacagcccuggcgggagcucuugaggccgaaauggacggcgccaaagggcgccugucuuccggccaccucaagugccggcugaaaauggauaaacuuagacugaaaggagugagcuacucucucuguacggcugccuucaccuuuacaaaggugcccgcugagacccugcauggcacaguuaccgucgaagugcaguaugccgggcgcgacggaccgugcaaggugccugcgcaaauggccgucgacaugcagacgcugacccccgugggccggcucauuacagcuaacccuguuaucaccgaguccacagaaaacagcaaaaugaugcuggagcuugauccucccuucggggacuccuacaucgugauuggagucggcgauaagaaaaucacccaccacuggcauagaucugggagcauuaucggcaaggccuuugaggcuacggugcgcggagccaaacggauggcgguucugggcgacacagccugggauuucggguccgugggaggcgucuucaauucucucgggaagggcauucaccagaucuuuggcgcugccuucaagagccuguuugggggcauguccugguucagccaaauccugauuggaacccuucucguguggcugggccugaacacaaagaaugggucuaucucccucaccugucuggcucuuggaggcguuaugauuuuucugagcaccgccgugucugccgacgucgggugcuccguggauuucagcaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8979 - RNA, 2347 nt, Artificial Sequence
  KX601166.1 prME-long mRNA Design 3 opt
gggagaaagcuuaccaugagaaucauuaacgcccggaaggagcgcaaaagacggggcgcugacaccagcaucgggauugugggacugcuccugacaacggccauggcggcugaaaucacccgcagaggcuccgccuacuauauguaccuugaucggucugacgccgggaaggcuauuagcuucgccacaacccugggagucaauaaaugccacguucagaucauggaucucggccauaugugugacgcuacaauguccuaugagugccccaugcuggaugaagggguggagcccgacgauguggacuguuggugcaacaccacaucuaccugggucguguacggaacgugucaccauaagaaaggcgaagcccgcagaagccggcgcgcgguuacccuuccgucccacucuacaagaaagcugcaaacccggagccagacauggcucgagucccgcgaguauaccaagcaucugaucaaaguggaaaauuggauuuuuagaaaccccggcuucgcccuggucgcuguggccaucgcuuggcuccuggggagcucuacgucccagaagguuauuuaccuugugaugauccugcucauugccccugcguauagcauccggugcauuggagucucuaaucgcgauuuuguggagggcauguccgggggaacauggguggacgucguucuggaacacggcgggugugugaccgugauggcccaggauaaacccacagucgacaucgagcuugugaccaccacaguuagcaacauggcugaggugagaucuuacugcuacgaagccuccaucagcgauauggcuuccgacucucgguguccuacgcaaggagaggccuaucuggacaagcagagcgauacccaguacgucugcaaaagaacacucguggaccgcggcuggggcaauggguguggacuguucggcaaggggucccugguuaccugcgccaaguuuacaugcagcaaaaagaugaccggaaaaucuauucagcccgaaaaccucgaguaucggaucaugcuguccgugcacggcagccaacauucugggaugauugucaaugaugaaaacagagcuaagguggaggucacgccuaauagcccgcgcgcggaggccacacuuggaggcuucggcucccuggggcucgacugugaaccccggaccggacuggauuuuucugaccuuuacuaucugaccaugaacaauaaacacuggcucgugcauaaggagugguuccacgauaucccucugcccuggcacgcuggcgccgacacagggaccccucauuggaacaauaaagaagcccugguugaguuuaaggaugcucacgccaagagacagacaguggucgugcucggaagccaggaaggcgcgguucauacggcucuggccggggcccuugaggcugagauggacggcgccaaaggacgccuguucuccggccaccucaagugccggcugaaaauggauaaacuuagacugaaaggggugagcuacucucucuguaccgcugccuuuacauucaccaagguccccgcggaaacacugcauggaaccgugacgguggagguucaguaugccggcaccgacgggccgugcaaggucccugcucaaauggccguggacaugcagacacugacccccgugggacgccucauuacagcuaacccugucaucaccgaauccacggagaacagcaaaaugaugcuggaacuugauccucccuuuggcgacucuuacaucgugauugggguuggcgauaagaaaaucacacaccacuggcaucgguccggaagcaccauuggcaaggccuucgaggcgacagugagaggggccaaacgcauggcuguccugggagacaccgccugggauuucggcuccguugggggaguguuuaauucucucggcaaggggauccaccagauuuucggcgcugccuuuaagagccuguucggaggcauguccugguuuucucaaauccugaucgggacccuucucguguggcugggacugaacacaaagaauggcagcauuucccucacgugucuggcccuugggggagucaugaucuuccugagcaccgcugugucugcggacguuggcugcuccguggauuuuagcaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8980 - RNA, 2365 nt, Artificial Sequence
  KF383118.1 prME-long mRNA Design 3 opt
gggagaaagcuuaccaugagaaucauuaacgcccggaaggagcgcaaaagacggggcgcugacaccagcaucgggauuaucggacugcuccugacaacggccauggcggcugaaauuacccgcagaggcuccgccuacuauauguaccuugaucggucugacgccgggaaggcuaucagcuucgccacaacccugggagugaauaaaugccacguccagaucauggaucucggccauaugugugacgcuacaauguccuaugagugccccaugcuggaugaagggguugagccugacgauguggacuguuggugcaacaccacaucuaccuggguggucuacggaacgugucaccauaagaaaggcgaaacccgcagaagccggcgcuccgugucucuuagauaucacuacacacggaagcugcaaacccgcagccagacauggcucgaguccagagaguauaagaaacaucugauuaugguugaaaauuggaucuuucggaacccgggcuucgccauugugagcgucgcgaucaccuggcugauggggucucucacgucccagaaggugauuuaccugguuaugaucgugcuuauuguccccgccuacagcaucucuugcaucggaguguccaaucgcgaucugguggagggcaugagcgggggaacaugggucgacguugugcucgaacacggcgggugugugaccgagauggcucaggauaaaccuacagucgacauugagcuggugaccaugaccguuucuaacauggccgaagugagauccuauugcuacgaggcuagccuuuccgauauggccucugcgagccggugucccacacaaggagaaccuucccuggacaagcagagcgacacgcagucugucugcaaaagaacccucggcgaucgcggcugggggaauggauguggcaucuuugggaagggaucccuggugacaugcagcaaguuuaccugcuguaaaaagaugcccggcaaaucuauucagccugagaaccuggaauaucggaucaugcucccgguucacgggagccaacauuccggaaugauugugaaugacaucggccacgagacagaugagaacagagccaaggucgaagugacccccaauucuccucgcgcugaggccacgcugggcggguuuggaagccuuggccuggacugcgaaccccggacagggcucgauuucuccgaccuguacuaucuuaccaugaacaauaaacauuggcugguccacaaggagugguuucacgauaucccucuccccuggcaugcuggagccgacaccggcacaccgcacuggaacaauaaagaagcccugguggaguucaaggaugcucaugcgaagagacagaccguugugguccuggggagccaggagggcgccgugcacacagcucucgccggagcccuggaagcugagauggacggcgccaaagggcgccuuuucucuggacaucugaagugucggcucaaaauggauaagcugagacuuaaaggcguuuccuacagccugugcacggcggcuuucaccuuuacaaaggugccugccgaaacccuccacgggacagucaccguggaggugcagucugccggaacggacggccccuguaagguuccugcucaaauggccgucgacaugcagacccugacacccguggggcgccugauuaccgcuaaccccgugaucacagaauccaccgagaacagcaaaaugaugcucgagcuggauccuccguucggcgacuccuauauugucaucggagugggcgauaagaaaauuacgcaccauuggcaccggucugggagcacaaucggaaaggccuuugaagcgaccguuagaggcgccaaacgcauggcugugcuuggggacacagccugggauuucggauccgucggcgggguguucaauucucugggcaagggaauccaucagauuuuuggcgcugccuucaagagccucuuugggggaauguccugguucagccaaauccugauuggcacccugcuuguuuggcucgggcugaacaccaaaaauggaucuaucucccugacaugccucgcgcugggcggggugaugauuuuucuuagcacggccgucucugcugacgugggcuguuccguugauuucagcaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8981 - RNA, 2359 nt, Artificial Sequence
  KF383120.1 prME-long mRNA Design 3 opt
gggagaaagcuuaccaugagaaucauuaacgcccggaaggagcgcaaaagacggggcgcugacaccagcaucgggauuaucggacugcuccugacaacggccauggcggcugaaauuacccgcagaggcuccgccuacuauauguaccuugaucggucugacgccgggaaggcuaucagcuucgccacaaccaugggagugaauaaaugccacguccagaucauggaucugggccauaugugugacgcuacaauguccuaugagugccccaugcucgaugaagggguugagccugacgauguggacuguuggugcaacaccacaucuaccuggguggucuacggaacgugucaccauaagaaaggcgaagcccgcccgagcagacgggcggugacccugcccucccacucuacacgcaaacuucaaaccagaagccagacauggcuggagucccgggaguauaccaagcaucucauuaagguugaaaauuggauccugcgcaacccuggcuuuacgguggccgcucuggccauggcuuggcuccuggggaauagcacaucucagagagucauuuaccuugugaugauccugcucauugcccccgcguauuccauccggugcauuggaguuagcaaccgcgauuucguggagggcaugucugggggaaccugggucgacguggugcuggaacacggcgggugugucacaguuauggcccaggauaagccuaccguggacaucgagcuugugaccacaacggucuccaauauggcugaggugagaagcuacugcuacgaagccucuaucuccgauauggcuagcgacucccggugucccacccaaggagaggccuaucuggacaaacagucugauacacaguacguuugcaagagaacccucguggaccgcggcuggggcaacggguguggacuguuuggcaaagggagccuggucacaugcgccaaguuuaccugcuccaagaaaaugacgggaaagagcauucagccugaaaaucucgaguaucggaucaugcugucugugcacggcucccaacauagcgggaugauuguuaacgauaucggacacgaaacagacgagaauagagcuaaaguggaggucaccccgaacucuccccgcgcggaagccacccuuggcggcuucgggagccugggacucgauugugagccucggacaggccuggacuucuccgaucuuuacuaucugaccaugaauaacaagcauuggcucgugcacaaagaaugguuucacgacauuccccugccuuggcaugcuggggccgauacaggaacgccccacuggaauaacaaggaggcccuggucgaguucaaagacgcucaugccaagagacagaccgugguugugcucggcucucaggaaggggcgguccacacagcucuggccggcgcccuugaggcugaaauggauggagccaagggccgccuguuuagcgggcaucucaaaugccggaucaagauggacaaacugagacuuaagggaguguccuacagccuguguaccgcugccuucacauuuucuaaaguuccggcggagacccuccacggcacggugaccgucgaagugcaguaugccgggcgcgacggaccuugcaaggugcccgcucaaauggccguugauaugcagacacugaccccugucggccggcugaucacagcuaaccccauuaucaccgaguccacggaaaauagcagaaugaugcucgagcuggaucccccuuucggggacucuuacauugugaucggcgugggagacaagaaaauuacacaccauuggcaccgcuccggcagcaccaucgggaaggccuuugaggcgacaguccggggagccaaaagaauggcugugcuuggcgauaccgccugggacuucggguccguuggaggcguguucaacucucuggggaagggcguccaucagguguuuggagcugccuucaaaagccucuuuggcgggauguccugguucucucaaauccugauuggaacccugcuuguuuggcucggccugaauacaaagaacgggagcaucucccuggccugucucgcucugggaggcgcgaugauuuuucuuagcacggccgugucugcugaugucgggugcuccguggacuucugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8982 - RNA, 2290 nt, Artificial Sequence; identical to SEQ ID NO: 8817
  KU321639.1 prME-short mRNA Design 3 opt

SEQ ID NO: 8983 - RNA, 2290 nt, Artificial Sequence; identical to SEQ ID NO: 8818
  KU312312.1 prME-short mRNA Design 3 opt

SEQ ID NO: 8984 - RNA, 2278 nt, Artificial Sequence; identical to SEQ ID NO: 8819
  AY632535.2 prME-short mRNA Design 3 opt

SEQ ID NO: 8985 - RNA, 2290 nt, Artificial Sequence; identical to SEQ ID NO: 8820
  KU527068.1 prME-short mRNA Design 3 opt

SEQ ID NO: 8986 - RNA, 2290 nt, Artificial Sequence
  KX421193.1 prME-short mRNA Design 3 opt
gggagaaagcuuaccaugaccagcaucggcauuaucgggcugcuccugacaacggccauggcugccgagauuaccagacggggauccgcguacuauauguaccuugaccgcucugaugcuggcaaggccaucagcuucgccacaacccugggggugaacaaaugccacguccagauuauggaccucggacauaugugugaugcuacaauguccuaugaaugccccaugcuggacgagggcguugaacccgaugacguggauuguuggugcaauaccacaucuaccuggguggucuacgggacgugucaccauaagaaaggagaggccagacggagccgcagagcugugacccuuccgucccacucuacacggaagcugcaaacccgcagccagacauggcucgaauccagagaguauaccaaacaucugaucaagguugagaacuggaucuuucggaaucccggcuucgcccugguggcggucgccauugcuuggcuccugggcagcucuacgucccagaaggugaucuaccuuguuaugauucugcucaucgccccugcuuauagcauucgcugcaucggggugucuaacagagacuuugucgaaggaauguccggcgggacauggguggaugugguccuggagcacggaggcuguguuaccgugauggcccaggacaaacccacaguggauauugaacuugucaccaccacagugagcaauauggcggagguucggucuuacugcuacgaggccuccaucagcgacauggcuuccgauucucgcuguccuacgcaaggggaagccuaucuggacaagcagagcgacacccaguacgugugcaaaagaacacucgucgaucggggauggggcaacggcugugggcuguucggaaagggcucccuggugaccugcgcuaaauuuacaugcagcaagaagaugaccgggaaaucuauccagcccgagaaucucgaauaucgcauuaugcuguccguucacggaagccaacauucuggcaugaucgugaacgacacgggguacgagacagaugaaaauagagccaaggucgaggugaccccuaacagcccgcgggccgaggcuacccuuggaggcuucggcucccuggggcucgacugugaacccagaacaggacuggauuuuucugaccuuuauuaccugaccaugaauaacaaacacuggcucguccauaaggagugguuccacgauauuccucugcccuggcacgcgggcgccgacacagggacgccucauuggaauaacaaagaagcucugguggaguuuaaggaugcccacgccaaacgccagaccguugugguccucggaagccaggaaggcgcugugcauacagcccuggcgggggcucuugaggccgagauggacggcgccaagggaaagcuguucuccggccaccucaaaugccggcugaagauggauaaacuuagacugaaggggguuagcuauucucucuguaccgcugccuuuacauucaccaaagugcccgcugaaacgcugcauggaaccgucacaguggaggugcaguacgccggcaccgacgggccgugcaagaucccuguucaaauggcggucgacaugcagacacugacccccgugggacgccucauuacggccaauccugugaucacagaauccaccgagaacagcaagaugaugcuggaacuugauccucccuuuggcgacucuuacaucgucauuggggugggcgauaaaaagaucacacaccacuggcaucgguccggaagcaccauuggcaaggcuuucgaggccaccguuagaggggcuaaacgcauggccgugcugggagacacagcgugggauuucggcuccgucgggggaguguuuaacucucucggcaaagggauccaccagauuuucggcgccgcuuuuaagagccuguucggaggcauguccugguuuucucaaauccugaucgggacgcuucucguuuggcugggacugaauaccaagaacggcagcauuucccucacaugucuggcccuugggggagugaugaucuuccugagcaccgcugucucugccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8987 - RNA, 2290 nt, Artificial Sequence
  KX377335.1 prME-short mRNA Design 3 opt
gggagaaagcuuaccaugaccagcaucggcauuaucgggcugcuccugacaacggccauggcugccgagauuaccagacggggauccgcguacuauauguaccuugaccgcucugaugcuggcaaggccaucagcuucgccacaacccugggggugaacaaaugccacguccagauuauggaccucggacauaugugugaugcuacaauguccuaugaaugccccaugcuggacgagggcguugaacccgaugacguggauuguuggugcaauaccacaucuaccuggguggucuacgggacgugucacagaaagaaaggagaggcccggcgcagcagacgggcugugacccuuccgucccauucuacacgcaagcugcaaaccagaagccagacauggcucgaaucccgggaguauaccaaacaccugaucaagguugagaacuggaucuuucgcaaucccggcuucgcccugguggcggucgccauugcuuggcuccugggcagcucuacgucccagaaggugaucuaccuuguuaugauucugcucaucgccccugcuuauagcauuagaugcaucggggugucuaaccgggacuuugucgaaggaauguccggcgggacauggguggaugugguccuggagcauggaggcuguguuaccgugauggcccaggacaaacccacaguggauauugaacuugucaccaccacagugagcaauauggcggagguucgcucuuacugcuacgaggccuccaucagcgacauggcuuccgauucuagauguccuacgcaaggggaagccuaucuggacaagcagagcgacacccaguacgugugcaaacggacacucgucgaucgcggauggggcaacggcugugggcuguucggaaagggcucccuggugaccugcgcuaaauuuacaugcagcaagaagaugaccgggaaaucuauccagcccgagaaucucgaauauagaauuaugcuguccguucacggaagccaacacucuggcaugaucgugaacgacacgggguacgagacagaugaaaaucgggccaaggucgaggugaccccuaacagcccgagagccgaggcuacccuuggaggcuucggcucccuggggcucgacugugaaccccgcacaggacuggauuuuucugaccuuuauuaccugaccaugaauaacaaacauuggcucguccacaaggagugguuccaugauauuccucugcccuggcacgcgggcgccgacacagggacgccucacuggaauaacaaagaagcucugguggaguuuaaggaugcccaugccaaacggcagaccguugugguccucggaagccaggaaggcgcugugcacacagcccuggcgggggcucuugaggccgagauggacggcgccaagggaaagcuguucuccggccaucucaaaugcagacugaagauggauaaacuucgccugaaggggguuagcuauucucucuguaccgcugccuuuacauucaccaaagugcccgcugaaacgcugcacggaaccgucacaguggaggugcaguacgccggcaccgacgggccgugcaagaucccuguucaaauggcggucgacaugcagacacugacccccgugggacggcucauuacggccaauccugugaucacagaauccaccgagaacagcaagaugaugcuggaacuugauccucccuuuggcgacucuuacaucgucauuggggugggcgauaaaaagaucacacaucacuggcacagauccggaagcaccauuggcaaggcuuucgaggccaccguucgcggggcuaaacggauggccgugcugggagacacagcgugggauuucggcuccgucgggggaguguuuaacucucucggcaaagggauccaucagauuuucggcgccgcuuuuaagagccuguucggaggcauguccugguuuucucaaauccugaucgggacgcuucucguuuggcugggacugaauaccaagaacggcagcauuucccucacaugucuggcccuugggggagugaugaucuuccugagcaccgcugucucugccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8988 - RNA, 2290 nt, Artificial Sequence
  LC002520.1 prME-short mRNA Design 3 opt
gggagaaagcuuaccaugaccagcaucggcauuaucgggcugcuccugacaacggccauggcugccgagauuaccagacggggauccgcguacuauauguaccuugaccgcucugaugcuggcaaggccaucagcuucgccacaacccugggggugaacaaaugccacguccagauuauggaccucggacauaugugugaugcuacaauguccuaugaaugccccaugcuggacgagggcguugaacccgaugacguggauuguuggugcaauaccacaucuaccuggguggucuacgggacgugucaccauaagaaaggagaggccagacggagccgcagagcugugacccuuccgucccacucuacacggaagcugcaaacccgcagccagacauggcucgaauccagagaguauaccaaacaucugaucaagguugagaacuggaucuuucggaaucccggcuucgcccugguggcggucgccauugcuuggcuccugggcagcucuacgucccagaaggugaucuaccuuguuaugauucugcucaucgccccugcuuauagcauucgcugcaucggggugucuaacagagacuuugucgaaggaauguccggcgggacauggguggaugugguccuggagcacggaggcuguguuaccgugauggcccaggacaaacccacaguggauauugaacuugucaccaccacagugagcaauauggcggagguucggucuuacugcuacgaggccuccaucagcgacauggcuuccgauucucgcuguccuacgcaaggggaagccuaucuggacaagcagagcgacacccaguacgugugcaaaagaacacucgucgaucggggauggggcaacggcugugggcuguucggaaagggcucccuggugaccugcgcuaaauuuacaugcagcaagaagaugaccgggaaaucuauccagcccgagaaucucgaauaucgcauuaugcuguccguucacggaagccaacauucuggcaugacggugaacgacaucggguacgagacagaugaaaauagagccaaggucgaggugaccccuaacagcccgcgggccgaggcuacccuuggaggcuucggcucccuggggcucgacugugaacccagaacaggacuggauuuuucugaccuuuauuaccugaccaugaauaacaaacacuggcucguccauaaggagugguuccacgauauuccucugcccuggcacgcgggcgccgacacagggacgccucauuggaauaacaaagaagcucugguggaguuuaaggaugcccacgccaaacgccagaccguugugguccucggaagccaggaaggcgcugugcauacagcccuggcgggggcucuugaggccgagauggacggcgccaagggaaagcuguucuccggccaccucaaaugccggcugaagauggauaaacuuagacugaaggggguuagcuauucucucuguaccgcugccuuuacauucaccaaagugcccgcugaaacgcugcauggaaccgucacaguggaggugcaguacgccggcaccgacgggccgugcaagaucccuguucaaauggcggucgacaugcagacacugacccccgugggacgccucauuacggccaauccugugaucacagaauccaccgagaacagcaagaugaugcuggaacuugauccucccuuuggcgacucuuacaucgucauuggggugggcgauaaaaagaucacacaccacuggcaucgguccggaagcaccauuggcaaggcuuucgaggccaccguuagaggggcuaaacgcauggccgugcugggagacacagcgugggauuucggcuccgucgggggaguguuuaacucucucggcaaagggauccaccagauuuucggcgccgcuuuuaagagccuguucggaggcauguccugguuuucucaaauccugaucgggacgcuucucguuuggcugggacugaauaccaagaacggcagcauuucccucacaugucuggcccuugggggagugaugaucuuccugagcaccgcugucucugccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8989 - RNA, 2272 nt, Artificial Sequence
  DQ859059.1 prME-short mRNA Design 3 opt
gggagaaagcuuaccaugaccagcaucggcauuguggggcugcuccugacaacggccauggcugccgagaucaccagacggggauccgcguacuauauguaccuugaccgcucugaugcuggcaaggccauuagcuucgccacaacccugggggucaacaaaugccacguucagaucauggaccucggacauaugugugaugcuacaauguccuaugaaugccccaugcuggacgagggcguggaacccgaugacguggauuguuggugcaauaccacaucuaccugggucguguacgggacgugucaccauaagaaaggagaggccagacggagccgcagagcuguuacccuuccgucccacucuacacggaagcugcaaacccgcagccagacauggcucgaauccagagaguauaccaaacaucugauuaagguggagaacuggaucuuucggaaucccggcuucacgcuggucgccguggcgaucgccuggcuccugggcagcucuacaucccagaagguuauuuaccuugugaugauccugcucauugcuccugccuauagcauccgcugcauuggggucucuaacagagacuuuguggaaggaauguccggcgggaccuggguggaugucguucuggagcacggaggcugugugacagugauggcucaggacaaacccaccgucgauaucgaacuugugaccacaacgguuagcaauauggccgaggugcggucuuacugcuacgaggcguccauuagcgacauggccuccgauucucgcuguccuacccaaggggaggcuuaucuggacaagcagagcgacacacaguacgucugcaaaagaacccucguggaucggggauggggcaacggcugugggcuguucggaaagggcucccugguuacaugcgccaaauuuaccugcagcaagaagaugacggggaaaucuauccagcccgaaaaucucgaauaucgcaucaugcuguccgugcacggaagccaacauucuggcaugauugucaacgacgagaauagagcuaagguggaagucacaccuaacagcccgcgggccgaggccacccuugggggauucggcucccugggccucgauugugagcccagaaccgggcuggacuuuucugaucuuuacuaucugacaaugaauaacaaacacuggcucgugcauaaggaaugguuccacgacaucccucugcccuggcacgcuggagcggauaccggcacaccucauuggaauaacaaagaggcccugguugaauuuaaggacgcucacgccaaacgccagacgguggucgugcucgggagccaggagggagccguucauaccgcucuggccggcgcgcuugaagcugagauggauggggccaagggccggcuguucuccggacaccucaagugcagacugaaaauggacaaacuucgccugaagggcgugagcuacucucucuguacagccgcuuuuaccuucacaaagguccccgccgagacccugcaugggacggugaccguggaaguucaguaugcuggaacagauggcccgugcaaagucccugcccaaauggcgguggacaugcagacccugacacccguggggcggcucauuaccgccaauccugucaucacggaguccacagaaaacagcaagaugaugcuggagcuugacccucccuuuggagauucuuacauugugaucggcguuggggacaagaaaaucacccaccacuggcauagauccggcagcacaauuggaaaggcuuucgaagccaccgugcgcggcgcuaaacggauggccguccugggggauaccgcgugggacuucggauccgugggcgggguuuuuaacucucucggaaagggcauccaccagauuuucggggccgcuuuuaaaagccuguucggcggaauguccugguuuucucaaauccugauuggcacacuucucguguggcuggggcugaauacgaagaacggaagcaucucccucaccugucuggcccuuggcggggucaugaucuuccugagcacagcugugucugccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8990 - RNA, 2278 nt, Artificial Sequence
  KU963573.2 prME-short mRNA Design 3 opt
gggagaaagcuuaccaugaccagcaucggcauuaucgggcugcuccugacaacggccauggcugccgagauuaccagacggggauccgcguacuauauguaccuugaccgcucugaugcuggcaaggccaucagcuucgccacaacccugggggugaacaaaugccacguccagauuauggaccucggacauaugugugaugcuacaauguccuaugaaugccccaugcuggacgagggcguugaacccgaugacguggauuguuggugcaauaccacaucuaccuggguggucuacgggacgugucaccauaagaaaggagaggccagacggagccgcagagcugugacccuuccgucccacucuacacggaagcugcaaacccgcagccagacauggcucgaauccagagaguauaccaaacaucugaucaagguugagaacuggaucuuucggaaucccggcuucgcccugguggcggucgccauugcuuggcuccugggcagcucuacgucccagaaggugaucuaccuuguuaugauucugcucaucgccccugcuuauagcauucgcugcaucggggugucuaacagagacuuugucgaaggaauguccggcgggacauggguggaugugguccuggagcacggaggcuguguuaccgugauggcccaggacaaacccacaguggauauugaacuugucaccaccacagugagcaauauggcggagguucggucuuacugcuacgaggccuccaucagcgacauggcuuccgauucucgcuguccuacgcaaggggaagccuaucuggacaagcagagcgacacccaguacgugugcaaaagaacacucgucgaucggggauggggcaacggcugugggcuguucggaaagggcucccuggugaccugcgcuaaauuuacaugcagcaagaagaugaccgggaaaucuauccagcccgagaaucucgaauaucgcauuaugcuguccguucacggaagccaacauucuggcaugaucggguacgagacggacgaaaacagagccaagguggaggucacaccuaauagcccgcgggccgaggcuacccuuggaggcuucggcucccuggggcucgauugugaacccagaaccggacuggacuuuucugaucuuuauuaccugacaaugaacaauaaacacuggcucgugcauaaggagugguuccacgacauuccucugcccuggcacgcgggcgccgauaccgggacaccucauuggaacaauaaagaagcucuggucgaguuuaaggacgcccacgccaaacgccagacggugguugugcucggaagccaggaaggcgcuguccauaccgcccuggcgggggcucuugaggccgagauggauggcgccaagggaaagcuguucuccggccaccucaaaugccggcugaagauggacaaacuuagacugaagggggugagcuauucucucuguacagcugccuuuaccuucacaaaaguucccgcugaaacccugcauggaacggugaccgucgaggugcaguacgccggcacagaugggccgugcaagaucccugugcaaauggcgguugacaugcagacccugacacccgucggacgccucauuaccgccaacccugugaucacggaauccacagagaauagcaagaugaugcuggaacuugacccucccuuuggcgauucuuacaucgugauuggggucggcgacaaaaagaucacccaccacuggcaucgguccggaagcacaauuggcaaggcuuucgaggccaccgugagaggggcuaaacgcauggccguucugggagauaccgcgugggacuucggcuccgucgggggaguguuuaacucucucggcaaagggauccaccagauuuucggcgccgcuuuuaagagccuguucggaggcauguccugguuuucucaaauccugaucgggacacuucucguguggcugggacugaacacgaagaauggcagcauuucccucaccugucuggcccuugggggaguuaugaucuuccugagcacagcugugucugccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8991 - RNA, 2290 nt, Artificial Sequence
  KX694534.2 prME-short mRNA Design 3 opt
gggagaaagcuuaccaugaccagcgugggcaucgucgggcugcuccugacaacggccauggcugccgagguuaccagacggggauccgcguacuauauguaccuugaccgcaacgaugcuggcgaagccauuucuuuccccacaacccuggggaugaauaagugcuauauccagauuauggaccucggacacaugugugaugccacaaugagcuacgagugcccuaugcuggacgaaggcguggagccggaugacguggauuguuggugcaacaccacauccaccugggucguguaugggacgugucaucacaaaaagggagaagcuagacggucucgcagagccguuacccuucccagccauuccacacggaaacugcaaacccgcucucagacauggcucgagagcagagaguacaccaagcaccugauccggguggaaaauuggauuuuucgcaacccuggcuucgcucuggccgcggccgcuaucgccuggcuccugggcuccagcacgucucagaaagucaucuaucuugugaugauucugcucaucgcucccgccuacuccauuagaugcaucgggguuagcaaucgggacuuuguggagggaaugucuggcgggacaugggucgauguggugcuggaacauggaggcugugucaccguuauggcgcaggacaagccuacaguggauauugagcuugugaccaccacagucuccaacauggccgaggugcgcagcuacugcuaugaagcuagcaucuccgacauggccagcgauuccagaugucccacgcaaggggaggcuuaccuggacaagcagucugacacccaguauguuugcaaacggacacucguggaucgcggauggggcaauggcugugggcuguucggaaagggcagccuggugaccugcgccaaauuugccugcuccaagaaaaugacagggaagucuauucagccugaaaaccucgaguacagaaucaugcugucugugcacggaucccaacacagcggcaugaucguuaaugacaccgggcaugaaacggaugagaaccgggcuaagguggagauuacacccaauucuccgagagcggaagccacccuuggaggcuucggcagccuggggcucgacugugagccucgcaccggacuggauuuuuccgaccuuuauuaccugacaaugaacaauaaacacuggcucguccauaaggaaugguuccacgauaucccccugccuuggcacgcuggcgccgacaccgggacaccccauuggaacaauaaagaggcccugguggaauuuaaggaugcucacgccaaacggcagacggucgugguucucggaucucaggagggcgcggugcauaccgcucuggccggggcccuugaggcugaaauggacggcgccaagggaagacugagcuccggccaccucaaaugccgccugaagauggauaagcugcggcugaaaggggucagcuauucucucuguacagcugccuucaccuuuacaaagauuccggcggagacccugcauggaacggugaccguugaagugcaguacgccggcacagacgggccuugcaaaguccccgcucaaauggccguggacaugcagacccugacaccugugggaagacucaucaccgcuaaccccguuauuacggaguccacagaaaacagcaagaugaugcuggagcuugaucccccuuucggcgacucuuacaucgucaucggggugggcgagaaaaagauuacccaccacuggcaucgcuccggaagcacaaucggcaaggccuuugaagcgaccgugagaggggccaaacggauggcuguccugggagauaccgccugggacuucggcuccgucgggggagcucucaauucucugggccgcgggauucaccagaucuucggcgccgccuuuaagagccuguucggaggcauguccugguuuucucaaauucuuaucgggacacuccugauguggcugggacucaacacgaaaaauggcagcaucucccugaugugucuugcucuugggggaguucucauuuuccugagcaccgcggugucugccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8992 - RNA, 2290 nt, Artificial Sequence
  KX369547.1 prME-short mRNA Design 3 opt
gggagaaagcuuaccaugaccagcgugggcaucgucgggcugcuccugacaacggccauggcugccgagguuaccagacggggauccgcguacuauauguaccuugaccgcaacgaugcuggcgaagccauuucuuuccccacaacccuggggaugaauaagugcuauauccagauuauggaccucggacacaugugugaugccacaaugagcuacgagugcccuaugcuggacgaaggcguggagccggaugacguggauuguuggugcaacaccacauccaccugggucguguaugggacgugucaucacaaaaagggagaagcuagacggucucgcagagccguuacccuucccagccauuccacacggaaacugcaaacccgcucucagacauggcucgagagcagagaguacaccaagcaccugauccggguggaaaauuggauuuuucgcaacccuggccuggcucucgccgcggccgcuaucgccuggcugcuuggcuccagcacgucucagaaagucaucuaucuggugaugauucuccugaucgcucccgccuacuccauuagaugcaucgggguuagcaaucgggacuucguggagggaaugucuggcgggacaugggucgauguggugcuugaacauggaggcugugucaccguuauggcgcaggacaagccuacaguggauauugagcuggugaccaccacagucuccaacauggccgaggugcgcagcuacugcuaugaagcuagcaucuccgacauggccagcgauuccagaugucccacgcaaggggaggcuuaccucgacaagcagucugacacccaguauguuugcaaacggacacugguggaucgcggauggggcaauggcugugggcuguuuggaaagggcagccucgugaccugcgccaaauucgccugcuccaagaaaaugacagggaagucuauucagccugaaaaccuggaguacagaaucaugcuuucugugcacggaucccaacacagcggcaugaucguuaaugacaccgggcaugaaacggaugagaaccgggcuaagguggagauuacacccaauucuccgagagcggaagccacccugggaggcuuuggcagccucgggcuggacugugagccucgcaccggacuugauuucuccgaccuguauuaccucacaaugaacaauaaacacuggcugguccauaaggaaugguuucacgauaucccccugccuuggcacgcuggcgccgacaccgggacaccccauuggaacaauaaagaggcccucguggaguucaaggaugcucacgccaaacggcagacggucgugguucugggaucucaggaaggcgcggugcauaccgcucuugccggggcccuggaggcugaaauggacggcgccaagggaagacucagcuccggccaccugaaaugccgccuuaagauggauaagcugcggcucaaaggggucagcuauucucuguguacagcugccuuuaccuucacaaagauuccggcggagacccugcauggaacggugaccguugaagugcaguacgccggcacagacgggccuugcaaaguccccgcucaaauggccguggacaugcagacccucacaccugugggaagacugaucaccgcuaaccccguuauuacggaguccacagaaaacagcaagaugaugcuugagcuggaucccccuuuuggcgacucuuacaucgucaucggggugggcgagaaaaagauuacccaccacuggcaucgcuccggaagcacaaucggcaaggccuucgaagcgaccgugagaggggccaaacggauggcuguccucggagauaccgccugggacuuuggcuccgucgggggagcucuuaauucucugggcaaggggauucaccagaucuucggcgccgccuucaaaagccuguuuggaggcauguccugguucucucaaauucucaucgggacacugcugauguggcucggacugaacacgaagaauggcagcaucucccuuaugugucuggcucucgggggaguucugauuuuucugagcaccgcggugucugccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8993 - RNA, 2290 nt, Artificial Sequence
  KX447515.1 prME-short mRNA Design 3 opt
gggagaaagcuuaccaugaccagcgugggcaucgucgggcugcuccugacaacggccauggcugccgagguuaccagacggggauccgcguacuauauguaccuugaccgcaacgaugcuggcgaagccauuucuuuccccacaacccuggggaugaauaagugcuauauccagauuauggaccucggacacaugugugaugccacaaugagcuacgagugcccuaugcuggacgaaggcguggagccggaugacguggauuguuggugcaacaccacauccaccugggucguguaugggacgugucaucacaaaaagggagaagcuagacggucucgcagagccguuacccuucccagccauuccacacggaaacugcaaacccgcucucagacauggcucgagagcagagaguacaccaagcaccugauccggguggaaaauuggauuuuucgcaacccuggcuucgcucuggccgcggccgcuaucgccuggcuccugggcuccagcacgucucagaaagucaucuaucuugugaugauucugcucaucgcucccgccuacuccauuagaugcaucgggguuagcaaucgggacuuuguggagggaaugucuggcgggacaugggucgauguggugcuggaacauggaggcugugucaccguuauggcgcaggacaagccuacaguggauauugagcuugugaccaccacagucuccaacauggccgaggugcgcagcuacugcuaugaagcuagcaucuccgacauggccagcgauuccagaugucccacgcaaggggaggcuuaccuggacaagcagucugacacccaguauguuugcaaacggacacucguggaucgcggauggggcaauggcugugggcuguucggaaagggcagccuggugaccugcgccaaauuugccugcuccaagaaaaugacagggaagucuauucagccugaaaaccucgaguacagaaucaugcugucugugcacggaucccaacacagcggcaugaucguuaaugacaccgggcaugaaacggaugagaaccgggcuaagguggagauuacacccaauucuccgagagcggaagccacccuuggaggcuucggcagccuggggcucgacugugagccucgcaccggacuggauuuuuccgaccuuuauuaccugacaaugaacaauaaacacuggcucguccauaaggaaugguuccacgauaucccccugccuuggcacgcuggcgccgacaccgggacaccccauuggaacaauaaagaggcccugguggaauuuaaggaugcucacgccaaacggcagacggucgugguucucggaucucaggagggcgcggugcauaccgcucuggccggggcccuugaggcugaaauggacggcgccaagggaagacugagcuccggccaccucaaaugccgccugaagauggauaagcugcggcugaaaggggucagcuauucucucuguacagcugccuucaccuuuacaaagauuccggcggagacccugcauggaacggugaccguugaagugcaguacgccggcacagacgggccuugcaaaguccccgcucaaauggccguggacaugcagacccugacaccugugggaagacucaucaccgcuaaccccguuauuacggaguccacagaaaacagcaagaugaugcuggagcuugaucccccuuucggcgacucuuacaucgucaucggggugggcgagaaaaagauuacccaccacugguaucgcuccggaagcacaaucggcaaggccuuugaagcgaccgugagaggggccaaacggauggcuguccugggagauaccgccugggacuucggcuccgucgggggagcucucaauucucugggcaaggggauucaucagaucuucggcgccgccuuuaaaagccuguucggaggcauguccugguuuucucaaauucuuaucgggacacuccugauguggcugggacucaacacgaagaauggcagcaucucccugaugugucuugcucuugggggaguucucauuuuccugagcaccgcggugucugccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8994 - RNA, 2290 nt, Artificial Sequence
  KU729218.1 prME-short mRNA Design 3 opt
gggagaaagcuuaccaugaccagcgugggcaucgucgggcugcuccugacaacggccauggcugccgagguuaccagacggggauccgcguacuauauguaccuugaccgcaacgaugcuggcgaagccauuucuuuccccacaacccuggggaugaauaagugcuauauccagauuauggaccucggacacaugugugaugccacaaugagcuacgagugcccuaugcuggacgaaggcguggagccggaugacguggauuguuggugcaacaccacauccaccugggucguguaugggacgugucaucacaaaaagggagaagcuagacggucucgcagagccguuacccuucccagccauuccacacggaaacugcaaacccgcucucagacauggcucgagagcagagaguacaccaagcaccugauccggguggaaaauuggauuuuucgcaacccuggcuucgcucuggccgcggccgcuaucgccuggcuccugggcuccagcacgucucagaaagucaucuaucuugugaugauucugcucaucgcucccgccuacuccauuagaugcaucgggguuagcaaucgggacuuuguggagggaaugucuggcgggacaugggucgauguggugcuggaacauggaggcugugucaccguuauggcgcaggacaagccuacaguggauauugagcuugugaccaccacagucuccaacauggccgaggugcgcagcuacugcuaugaagcuagcaucuccgacauggccagcgauuccagaugucccacgcaaggggaggcuuaccuggacaagcagucugacacccaguauguuugcaaacggacacucguggaucgcggauggggcaauggcugugggcuguucggaaagggcagccuggugaccugcgccaaauuugccugcuccaagaaaaugacagggaagucuauucagccugaaaaccucgaguacagaaucaugcugucugugcacggaucccaacacagcggcaugaucguuaaugacaccgggcaugaaacggaugagaaccgggcuaagguggagauuacacccaauucuccgagagcggaagccacccuuggaggcuucggcagccuggggcucgacugugagccucgcaccggacuggauuuuuccgaccuuuauuaccugacaaugaacaauaaacacuggcucguccauaaggaaugguuccacgauaucccccugccuuggcacgcuggcgccgacaccgggacaccccauuggaacaauaaagaggcccugguggaauuuaaggaugcucacgccaaacggcagacggucgugguucucggaucucaggagggcgcggugcauaccgcucuggccggggcccuugaggcugaaauggacggcgccaagggaagacugagcuccggccaccucaaaugccgccugaagauggauaagcugcggcugaaaggggucagcuauucucucuguacagcugccuucaccuuuacaaagauuccggcggagacccugcauggaacggugaccguugaagugcaguacgccggcacagacgggccuugcaaaguccccgcucaaauggccguggacacccagacacugaccccugugggaagacucaucacggcuaaccccguuauuacagaguccaccgaaaacagcaagaugaugcuggagcuugaucccccuuucggcgacucuuacaucgucaucggggugggcgagaaaaagauuacacaccacuggcaucgcuccggaagcaccaucggcaaggccuuugaagcgaccgugagaggggccaaacggauggcuguccugggagauacagccugggacuucggcuccgucgggggagcucucaauucucugggcaaggggauucaccagaucuucggcgccgccuuuaaaagccuguucggaggcauguccugguuuucucaaauucuuaucgggacgcuccugauguggcugggacucaacaccaagaauggcagcaucucccugaugugucuugcucuugggggaguucucauuuuccugagcacagcggugucugccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8995 - RNA, 2290 nt, Artificial Sequence
  KU501217.1 prME-short mRNA Design 3 opt
gggagaaagcuuaccaugaccagcgugggcaucgucgggcugcuccugacaacggccauggcugccgagguuaccagacggggauccgcguacuauauguaccuugaccgcaacgaugcuggcgaagccauuucuuuccccacaacccuggggaugaauaagugcuauauccagauuauggaccucggacacaugugugaugccacaaugagcuacgagugcccuaugcuggacgaaggcguggagccggaugacguggauuguuggugcaacaccacauccaccugggucguguaugggacgugucaucacaaaaagggagaagcuagacggucucgcagagccguuacccuucccagccauuccacacggaaacugcaaacccgcucucagacauggcucgagagcagagaguacaccaagcaccugauccggguggaaaauuggauuuuucgcaacccuggcuucgcucuggccgcggccgcuaucgccuggcuccugggcuccagcacgucucagaaagucaucuaucuugugaugauucugcucaucgcucccgccuacuccauuagaugcaucgggguuagcaaucgggacuuuguggagggaaugucuggcgggacaugggucgauguggugcuggaacauggaggcugugucaccguuauggcgcaggacaagccuacaguggauauugagcuugugaccaccacagucuccaacauggccgagauccgcagcuacugcuaugaagcuagcauuuccgacauggccagcgauuccagaugucccacgcaaggggaggcuuaccuggacaagcagucugacacccaguaugugugcaaacggacacucguugaucgcggauggggcaauggcugugggcuguucggaaagggcagccuggugaccugcgccaaauuugccugcuccaagaaaaugacagggaagucuauccagccugaaaaccucgaguacagaaucaugcugucuguccacggaucccaacacagcggcaugauugugaaugacaccgggcaugaaacggaugagaaccgggcuaagguugagaucacacccaauucuccgagagcggaagccacccuuggaggcuucggcagccuggggcucgacugugagccucgcaccggacuggauuuuuccgaccuuuauuaccugacaaugaacaauaaacacuggcucgugcauaaggaaugguuccacgauauuccccugccuuggcacgcuggcgccgacaccgggacaccccauuggaacaauaaagaggcccuggucgaauuuaaggaugcucacgccaaacggcagacgguggucgugcucggaucucaggagggcgcgguucauaccgcucuggccggggcccuugaggcugaaauggacggcgccaagggaagacugagcuccggccaccucaaaugccgccugaagauggauaagcugcggcugaaaggggugagcuauucucucuguacagcugccuucaccuuuacaaagaucccggcggagacccugcauggaacggucaccguggaaguucaguacgccggcacagacgggccuugcaaagugcccgcucaaauggccgucgacaugcagacccugacaccugugggaagacucauuaccgcuaaccccgugaucacggaguccacagaaaacagcaagaugaugcuggagcuugaucccccuuucggcgacucuuacaucguuauuggggucggcgagaaaaagaucacccaccacuggcaucgcuccggaagcacaauuggcaaggccuuugaagcgaccgugagaggggccaaacggauggcugugcugggagauaccgccugggacuucggcuccgucgggggagcucucaauucucugggcaaggggauccaccagauuuucggcgccgccuuuaaaagccuguucggaggcauguccugguuuucucaaauccuuaucgggacacuccugauguggcugggacucaacacgaagaauggcagcauuucccugaugugucuugcucuugggggagugcucaucuuccugagcaccgcgguuucugccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8996 - RNA, 2290 nt, Artificial Sequence
  KU312314.1 prME-short mRNA Design 3 opt
gggagaaagcuuaccaugaccagcgugggcaucgucgggcugcuccugacaacggccauggcugccgagguuaccagacggggauccgcguacuauauguaccuugaccgcaacgaugcuggcgaagccauuucuuuccccacaacccuggggaugaauaagugcuauauccagauuauggaccucggacacaugugugaugccacaaugagcuacgagugcccuaugcuggacgaaggcguggagccggaugacguggauuguuggugcaacaccacauccaccugggucguguaugggacgugucaucacaaaaagggagaagcuagacggucucgcagagccguuacccuucccagccauuccacacggaaacugcaaacccgcucucagacauggcucgagagcagagaguacaccaagcaccugauccggguggaaaauuggauuuuucgcaacccuggcuucgcucuggccgcggccgcuaucgccuggcuccugggcuccagcacgucucagaaagucaucuaucuugugaugauucugcucaucgcucccgccuacuccauuagaugcaucgggguuagcaaucgggacuuuguggagggaaugucuggcgggacaugggucgauguggugcuggaacauggaggcugugucaccguuauggcgcaggacaagccuacaguggauauugagcuugugaccaccacagucuccaacauggccgaggugcgcagcuacugcuaugaagccucuaucuccgacauggcuagcgauuccagaugucccacgcaaggggaggcuuaccuggacaagcagucugacacccaguauguuugcaaacggacacucguggaucgcggauggggcaauggcugugggcuguucggaaagggcagccuggugaccugcgccaaauuugccugcuccaagaaaaugacaggaaagagcauucagccugaaaaccucgaguacagaaucaugcugucugugcacgggucccaacacagcggcaugaucguuaaugacaccgggcaugaaacggaugagaaccgggcuaagguggagauuacacccaauucucccagagcggaagccacccuuggaggcuucggcagccuggggcucgacugugagccucgcaccggacuggauuuuuccgaccuuuauuaccugacaaugaacaauaaacacuggcucguccauaaggaaugguuccacgauaucccccugccuuggcacgcuggcgccgacaccgggacaccccauuggaacaauaaagaggcccugguggaauuuaaggaugcucacgccaaacggcagacggucgugguucucggaucucaggagggcgcggugcauaccgcucuggccggggcccuugaggcugaaauggacggcgccaagggaagacugagcuccggccaccucaaaugccgccugaagauggauaagcugcggcugaaaggggucagcuauucucucuguacagcugccuucaccuuuacaaagauuccggcggagacccugcauggaacggugaccguugaagugcaguacgccggcacagacgggccuugcaaaguccuggcucaaauggccguggacaugcagacccucacacccgugggaagacugaucaccgcuaacccuguuauuacggaguccacagaaaacagcaagaugaugcuugagcuggauccgcccuucggcgacucuuacaucgucaucggggugggcgagaaaaagauuacccaccacuggcaucgcuccggaagcacaaucggcaaggccuuugaagcgaccgugagaggggccaaacggauggcuguccucggagauaccgccugggacuucggcuccgucgggggagcucuuaauucucugggcaaggggauucaccagaucuucggcgccgccuuuaaaagccuuuucggaggcauguccugguuuucucaaauucucaucgggacacugcugauguggcucggacugaacacgaagaauggcagcaucucccuuaugugucuggcucucgggggaguucugauuuuccugagcaccgcggugucugccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8997 - RNA, 2290 nt, Artificial Sequence
  KX446950.2 prME-short mRNA Design 3 opt
gggagaaagcuuaccaugaccagcgugggcaucgucgggcugcuccugacaacggccauggcugccgagguuaccagacggggauccgcguacuauauguaccuugaccgcaacgaugcuggcgaagccauuucuuuccccacaacccuggggaugaauaagugcuauauccagauuauggaccucggacacaugugugaugccacaaugagcuacgagugcccuacccuggacgaaggcguggagccggaugacguggauuguuggugcaacacaaccuccacgugggucguguaugggaccugucaucacaaaaagggagaagcuagacggucucgcagagccguuacacuucccagccauuccacccggaaacugcaaacacgcucucagaccuggcucgagagcagagaguacacgaagcaccugauccggguggaaaauuggauuuuucgcaacccuggcuucgcucuggccgcggccgcuaucgccuggcuccugggcuccagcacaucucagaaagucaucuaucuugugaugauucugcucaucgcucccgccuacuccauuagaugcaucgggguuagcaaucgggacuuuguggagggaaugucuggcgggaccugggucgauguggugcuggaacauggaggcugugucacaguuauggcgcaggacaagccuaccguggauauugagcuugugaccacaacggucuccaacauggccgaggugcgcagcuacugcuaugaagcuagcaucuccgacauggccagcgauuccagaugucccacccaaggggaggcuuaccuggacaagcagucugacacacaguauguuugcaaacggacccucguggaucgcggauggggcaauggcugugggcuguucggaaagggcagccuggucacaugcgccaaauuugccugcuccaagaaaaugaccgggaagucuauucagccugaaaaccucgaguacagaaucaugcugucugugcacggaucccaacacagcggcaugaucguuaaugacacggggcaugaaacagaugagaaccgggcuaagguggagauuacccccaauucuccgagagcggaagccacccuuggaggcuucggcagccuggggcucgacugugagccucgcacaggacuggauuuuuccgaccuuuauuaccugaccaugaacaauaaacacuggcucguccauaaggaaugguuccacgauaucccccugccuuggcacgcuggcgccgacacagggacgccccauuggaacaauaaagaggcccugguggaauuuaaggaugcucacgccaaacggcagaccgucgugguucucggaucucaggagggcgcggugcauacagcucuggccggggcccuugaggcugaaauggacggcgccaagggaagacugagcuccggccaccucaaaugccgccugaagauggauaagcugcggcugaaaggggucagcuauucucucuguaccgcugccuucacauuuaccaagauuccggcggagacgcugcauggaaccgugacaguugaagugcaguacgccggcaccgacgggccuugcaaaguccccgcucaaauggccguggacaugcagacacugaccccugugggaagacucaucacggcuaaccccguuauuacagaguccaccgaaaacagcaagaugaugcuggagcuugaucccccuuucggcgacucuuacaucgucaucggggugggcgagaaaaagauuacacaccacuggcaucgcuccggaagcaccaucggcaaggccuuugaagcgaccgugagaggggccaaacggauggcuguccugggagauacagccugggacuucggcuccguugggggagcucucaauucucugggcaaggggauucaccagaucuucggcgccgccuuuaaaagccuguucggaggcauguccugguuuucucaaauucuuaucgggacgcuccugauguggcugggacucaacaccaagaauggcagcaucucccugaugugucuugcucuugggggagugcucauuuuccugagcacagcggugucugccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8998 - RNA, 2290 nt, Artificial Sequence
  KY003157.1 prME-short mRNA Design 3 opt
gggagaaagcuuaccaugaccagcgugggcaucgucgggcugcuccugacaacggccauggcugccgagguuaccagacggggauccgcguacuauauguaccuugaccgcaacgaugcuggcgaagccauuucuuuccccacaacccuggggaugaauaagugcuauauccagauuauggaccucggacacaugugugaugccacaaugagcuacgagugcccuaugcuggacgaaggcguggagccggaugacguggauuguuggugcaacaccacauccaccugggucguguaugggacgugucaucacaaaaagggagaagcuagacggucucgcagagccguuacccuucccagccauuccacacggaaacugcaaacccgcucucagacauggcucgagagcagagaguacaccaagcaccugauccggguggaaaauuggauuuuucgcaacccuggcuucgcucuggccgcggccgcuaucgccuggcuccugggcuccagcacgucucagaaagucaucuaucuugugaugauucugcucaucgcucccgccuacuccauuagaugcaucgggguuagcaaucgggacuuuguggagggaaugucuggcgggacaugggucgauguggugcuggaacauggaggcugugucaccguuauggcgcaggacaagccuacaguggauauugagcuugugaccaccacagucuccaacauggccgaggugcgcagcuacugcuaugaagcuagcaucuccgacauggccagcgauuccagaugucccacgcaaggggaggcuuaccuggacaagcagucugacacccaguauguuugcaaacggacacucguggaucgcggauggggcaauggcugugggcuguucggaaagggcagccuggugaccugcgccaaauuugccugcuccaagaaaaugacagggaagucuauucagccugaaaaccucgaguacagaaucaugcugucugugcacggaucccaacacagcggcaugaucguuaaugacaccgggcaugaaacggaugagaaccgggcuaagguggagauuacacccaauucuccgagagcggaagccacccuuggaggcuucggcagccuggggcucgacugugagccucgcaccggacuggauuuuuccgaccuuuauuaccugacaaugaacaauaaacacuggcucguccauaaggaaugguuccacgauaucccccugccuuggcacgcuggcgccgacaccgggacaccccauuggaacaauaaagaggcccugguggaauuuaaggaugcucacgccaaacggcagacggucgugguucucggaucucaggagggcgcggugcauaccgcucuggccggggcccuugaggcugaaauggacggcgccaagggaagacugagcuccggccaccucaaaugccgccugaagauggauaagcugcggcugaaaggggucagcuauucucucuguacagcugccuucaccuuuacaaagauuccggcggagacccugcauggaacggugaccguugaagugcaguacgccggcacagacgggccuugcaaaguccccgcucaaauggccguggacaugcagacccugacaccugugggaagacucaucaccgcuaaccccguuauuacggaguccacagaaaacagcaagaugaugcuggagcuugaucccccuuucggcgacucuuacaucgucaucggggugggcgagaaaaagauuacccaccacuggcaucgcuccggaagcacaaucggcaaggccuuugaagcgaccgugagaggggccaaacggauggcuguccugggagauaccgccugggacuucggcuccgucgggggagcucucaauucucugggcaaggggauucaccagaucuucggcgccgccuuuaaaagccuguucggaggcauguccugguuuucucaaauucuuaucgggacacuccugauguggcugggacucaacacgaagaauggcagcaucucccugaugugucuugcucuugggggaguucucauuuuccugagcaccguggucucugcgugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8999 - RNA, 2290 nt, Artificial Sequence
  KX811222.1 prME-short mRNA Design 3 opt
gggagaaagcuuaccaugaccagcgugggcaucgucgggcugcuccugacaacggccauggcugccgagguuaccagacggggauccgcguacuauauguaccuugaccgcaacgaugcuggcgaagccauuucuuuccccacaacccuggggaugaauaagugcuauauccagauuauggaccucggacacaugugugaugccacaaugagcuacgagugcccuaugcuggacgaaggcguggagccggaugacguggauuguuggugcaacaccacauccgcuugggucguguaugggaccugucaucacaaaaagggagaagccagacggucucgcagagcuguuacgcuucccagccauuccacccggaaacugcaaacacgcccucagaccuggcucgagucuagagaguacacaaagcaccugauccggguggaaaauuggauuuuucgcaaccccggcuucgcccuggcggccgcugccaucgcuuggcuccugggcagcuccaccagccagaaagucaucuaucuugugaugauucugcucaucgccccugcguacucuauuagaugcaucgggguuuccaaucgggacuuuguggagggaaugagcggcgggacgugggucgauguggugcuggaacauggaggcugugucacaguuauggcccaggacaagcccaccguggauauugagcuugugacaaccaccgucucuaacauggcugaggugcgcuccuacugcuaugaagccagcaucucugacauggcuuccgauagcagauguccuacacaaggggaggccuaccuggacaagcaguccgacacgcaguauguuugcaaacggacccucguggaucgcggauggggcaauggcugugggcuguucggaaagggcucucuggucacaugcgccaaauuugcuugcagcaagaaaaugaccgggaaguccauucagccggaaaaccucgaguacagaaucaugcugagcgugcacggaucucaacacuccggcaugaucguuaaugacacagggcaugaaaccgaugagaaccgggcgaagguggagauuacgcccaauagcccuagagccgaagcuacacuuggaggcuucggcucucuggggcucgacugugagccccgcaccggacuggauuuuagcgaccuuuauuaccugaccaugaacaauaaacacuggcucguccauaaggaaugguuccacgauaucccucugcccuggcacgccggcgccgacacagggaccccgcauuggaacaauaaagaggcucugguggaauuuaaggaugcccacgcgaaacggcagacagucgugguucucggaucccaggagggcgcugugcauacggcccuggccggggcucuugaggccgaaauggacggcgcuaagggaagacugucuagcggccaccucaaaugccgccugaagauggauaagcugcggcugaaaggggucuccuauagccucuguaccgccgcguucacauuuaccaagauuccugccgagacacugcauggaaccgugacgguugaagugcaguacgcuggcaccgacgggcccugcaaagucccugcccaaauggcuguggacaugcagacacugacccccgugggaagacucaucacagccaaccccguuauuaccgagucuacggaaaacuccaagaugaugcuggagcuugauccuccguucggcgacagcuacaucgucaucggggugggcgagaaaaagauuacacaccacuggcaucgcucuggauccaccaucggcaaggcguuugaagccacagugagaggggcuaaacggauggccguccugggagauaccgcuugggacuucggcagcguugggggagcccucaauucccugggcaaggggauucaccagaucuucggcgccgcuuuuaaaucucuguucggaggcaugagcugguuuucccaaauucuuaucgggacccuccugauguggcugggacucaacacaaagaauggcucuaucagccugaugugucuugcgcuugggggagugcucauuuuccuguccacggccgugagcgcuugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9000 - RNA, 2290 nt, Artificial Sequence
  KX447516.1 prME-short mRNA Design 3 opt
gggagaaagcuuaccaugaccagcgugggcaucgucgggcugcuccugacaacggccauggcugccgagguuaccagacggggauccgcguacuauauguaccuugaccgcaacgaugcuggcgaagccauuucuuuccccacaacccuggggaugaauaagugcuauauccagauuauggaccucggacacaugugugaugccacaaugagcuacgagugcccuaugcuggacgaaggcguggagccggaugacguggauuguuggugcaacaccacauccaccugggucguguaugggacgugucaucacaaaaagggagaagcuagacggucucgcagagccguuacccuucccagccauuccacacggaaacugcaaacccgcucucagacauggcucgagagcagagaguacaccaagcaccugauccggguggaaaauuggauuuuucgcaacccuggcuucgcucuggccgcggccgcuaucgccuggcuccugggcuccagcacgucuaaaaaggucaucuaucuugugaugauucugcucaucgcucccgccuacuccauuagaugcaucgggguuagcaaucgggacuuuguggagggaaugucuggcgggacaugggucgauguggugcuggaacauggaggcugugucaccguuauggcgcaggacaagccuacaguggauauugagcuugugaccaccacagucuccaacauggccgaggugcgcagcuacugcuaugaagcuagcaucuccgacauggccagcgauuccagaugucccacgcagggggaggcuuaccuggacaaacaaucugacacccaguauguuugcaagcggacacucguggaucgcggauggggcaauggcugugggcuguucggaaaaggcagccuggugaccugcgccaaguuugccugcuccaaaaagaugacagggaagucuauucagccugaaaaccucgaguacagaaucaugcugucugugcacggaucccagcacagcggcaugaucguuaaugacaccgggcaugaaacggaugagaaccgggcuaaaguggagauuacacccaauucuccgagagcggaagccacccuuggaggcuucggcagccuggggcucgacugugagccucgcaccggacuggauuuuuccgaccuuuauuaccugacaaugaacaauaagcacuggcucguccauaaagaaugguuccacgauaucccccugccuuggcacgcuggcgccgacaccgggacaccccauuggaacaauaaggaggcccugguggaauuuaaagaugcucacgccaagcggcaaacggucgugguucucggaucucaggagggcgcggugcauaccgcucuggccggggcccuugaggcugaaauggacggcgccaaaggaagacugagcuccggccaccucaagugccgccugaagauggauaaacuucggcugaagggggucagcuauucucucuguacagcugccuucaccuuuacaaaaauuccggcggagacccugcauggaacggugaccguugaagugcaguacgccggcacagacgggccuugcaagguccccgcucagauggccguggacaugcaaacccugacaccugugggaagacucaucaccgcuaaccccguuauuacggaguccacagaaaacagcaaaaugaugcuggagcuugaucccccuuucggcgacucuuacaucgucaucggggugggcgagaagaagauuacccaccacuggcaucgcuccggaagcacaaucggcaaagccuuugaagcgaccgugagaggggccaagcggauggcuguccugggagauaccgccugggacuucggcuccgucgggggagcucucaauucucugggcaaagggauucaccagaucuucggcgccgccuuuaagagccuguucggaggcauguccugguuuucucagauucuuaucgggacacuccugauguggcugggacucaacacgaaaaauggcagcaucucccugaugugucuugcucucgggggaguucugauuuuccugagcaccgcggugucugccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9001 - RNA, 2290 nt, Artificial Sequence
  KX520666.1 prME-short mRNA Design 3 opt
gggagaaagcuuaccaugaccagcgugggcaucgucgggcugcuccugacaacggccauggcugccgagguuaccagacggggauccgcguacuauauguaccuugaccgcaacgaugcuggcgaagccauuucuuuccccacaacccuggggaugaauaagugcuauauccagauuauggaccucggacacaugugugaugccacaaugagcuacgagugcccuaugcuggacgaaggcguggagccggaugacguggauuguuggugcaacaccacauccaccugggucguguaugggacgugucaucacaaaaagggagaagcuagacggucucgcagagccguuacccuucccagccauuccacacggaaacugcaaacccgcucucagacauggcucgagagcagagaguacaccaagcaccugauccggguggaaaauuggauuuuucgcaacccuggcuucgcucuggccgcggccgcuaucgccuggcuccugggcuccagcacgagacagaaagucaucuaucuugugaugauucugcucaucgcucccgccuacucuauucggugcaucgggguuuccaaucgcgacuuuguggagggaaugagcggcgggacaugggucgauguggugcuggaacauggaggcugugucaccguuauggcgcaggacaagccuacaguggauauugagcuugugaccaccacagucucuaacauggccgaggugagauccuacugcuaugaagcuagcaucucugacauggccuccgauagccggugucccacgcaaggggaggcuuaccuggacaagcaguccgacacccaguauguuugcaaacgcacacucguggauagaggauggggcaauggcugugggcuguucggaaagggcucucuggugaccugcgccaaauuugccugcagcaagaaaaugacagggaaguccauucagccugaaaaccucgaguaccggaucaugcugagcgugcacggaucucaacacuccggcaugaucguuaaugacaccgggcaugaaacggaugagaacagagcuaagguggagauuacaccgaauagcccccgcgcggaagccacccuuggaggcuucggcucucuggggcucgacugugagccucggaccggacuggauuuuagcgaccuuuauuaccugacaaugaacaauaaacacuggcucguccauaaggaaugguuccacgauaucccccugccuuggcacgcuggcgccgacaccgggacaccccauuggaacaauaaagaggcccugguggaauuuaaggaugcucacgccaaaagacagacggucgugguucucggaucccaggagggcgcggugcauaccgcucuggccggggcccuugaggcugaaauggacggcgccaagggacgccugucuagcggccaccucaaaugccggcugaagauggauaagcugagacugaaaggggucuccuauagccucuguacagcugccuucaccuuuacaaagauuccggcggagacccugcauggaacggugaccguugaagugcaguacgccggcacagacgggccuugcaaaguccccgcucaaauggccguggacaugcagacccugacaccugugggacgccucaucaccgcuaaccccguuauuacggagucuacagaaaacuccaagaugaugcuggagcuugaucccccuuucggcgacagcuacaucgucaucggggugggcgagaaaaagauuacccaccacuggcaucggucuggauccacaaucggcaaggccuuugaagcgaccgugagaggggccaaacgcauggcuguccugggagauaccgccugggacuucggcagcgucgggggagcucucaauucccugggcaaggggauucaccagaucuucggcgccgccuuuaaaucucuguucggaggcaugagcugguuuucccaaauucuuaucgggacacuccugauguggcugggacucaacacgaagaauggcucuaucagccugaugugucuugcucuugggggaguucucauuuuccuguccaccgcggugagcgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9002 - RNA, 2290 nt, Artificial Sequence
  KU497555.1 prME-short mRNA Design 3 opt
gggagaaagcuuaccaugaccagcgugggcaucgucgggcugcuccugacaacggccauggcugccgagguuaccagacggggauccgcguacuauauguaccuugaccgcaacgaugcuggcgaagccauuucuuuccccacaacccuggggaugaauaagugcuauauccagauuauggaccucggacacaugugugaugccacaaugagcuacgagugcccuaugcuggacgaaggcguggagccggaugacguggauuguuggugcaacaccacauccaccugggucguguaugggacgugucaucacaaaaagggagaagcuagacggucucgcagagccguuacccuucccagccauuccacacggaaacugcaaacccgcucucagacauggcucgagagcagagaguacaccaagcaccugauccggguggaaaauuggauuuuucgcaacccuggcuucgcucuggccgcggccgcuaucgccuggcuccugggcuccagcacgucucagaaagucaucuaucuugugaugauucugcucaucgcucccgccuacuccauuagaugcaucgggguuagcaaucgggacuuuguggagggaaugucuggcgggacaugggucgauguggugcuggaacauggaggcugugucaccguuauggcgcaggacaagccuacaguggauauugagcuugugaccaccacagucuccaacauggccgaggugcgcagcuacugcuaugaagcuagcaucuccgacauggccagcgauuccagaugucccacgcaaggggaggcuuaccuggacaagcagucugacacccaguauguuugcaaacggacacucguggaucgcggauggggcaauggcugugggcuguucggaaagggcagccuggugaccugcgccaaauuugccugcuccaagaaaaugacagggaagucuauucagccugaaaaccucgaguacagaaucaugcugucugugcacggaucccaacacagcggcaugaucguuaaugacaccgggcaugaaacggaugagaaccgggcuaagguggagauuacacccaauucuccgagagcggaagccacccuuggaggcuucggcagccuggggcucgacugugagccucgcaccggacuggauuuuuccgaccuuuauuaccugacaaugaacaauaaacacuggcucguccauaaggaaugguuccacgauaucccccugccuuggcacgcuggcgccgacaccgggacaccccauuggaacaauaaagaggcccugguggaauuuaaggaugcucacgccaaacggcagacggucgugguucucggaacccaggagggcgcggugcauacagcucuggccggggcccuugaggcugaaauggacggcgccaagggaagacugucuagcggccaccucaaaugccgccugaagauggauaagcugcggcugaaaggggucuccuauagccucuguaccgcugccuucacauuuaccaagauuccggcggagacgcugcauggaaccgugacaguugaagugcaguacgccggcaccgacgggccuugcaaaguccccgcucaaauggccguggacaugcagacacugaccccugugggaagacucaucacggcuaaccccguuauuacagagucuaccgaaaacuccaagaugaugcuggagcuugaucccccuuucggcgacagcuacaucgucaucggggugggcgagaaaaagauuacacaccacuggcaucgcucuggauccaccaucggcaaggccuuugaagcgaccgugagaggggccaaacggauggcuguccugggagauacagccugggacuucggcagcgucgggggagcucucaauucccugggcaaggggauucaccagaucuucggcgccgccuuuaaaucucuguucggaggcaugagcugguuuucccaaauucuuaucgggacgcuccugauguggcugggacucaacaccaagaauggcucuaucagccugaugugucuugcucuugggggaguucucauuuuccuguccacagcggugagcgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9003 - RNA, 2290 nt, Artificial Sequence
  KY075939.1 prME-short mRNA Design 3 opt
gggagaaagcuuaccaugaccagcgugggcaucgucgggcugcuccugacaacggccauggcugccgagguuaccagacggggauccgcguacuauauguaccuugaccgcaacgaugcuggcgaagccauuucuuuccccacaacccuggggaugaauaagugcuauauccagauuauggaccucggacacaugugugaugccacaaugagcuacgagugcccuaugcuggacgaaggcguggagccggaugacguggauuguuggugcaacaccacauccaccugggucguguaugggacgugucaucacaaaaagggagaagcuagacggucucgcagagccguuacccuucccagccauuccacacggaaacugcaaacccgcucucagacauggcucgagagcagagaguacaccaagcaccugauccggguggaaaauuggauuuuucgcaacccuggcuucgcucuggccgcggccgcuaucgccuggcuccugggcuccagcacgucucagaaagucaucuaucuugugaugauucugcucaucgcucccgccuacucccugagaugcauugggguuagcaaucgggacuuuguggagggaaugucuggcgggacaugggucgauguggugcuugaacauggaggcugugucaccguuauggcgcaggacaagccuacaguggauaucgagcuggugaccaccacagucuccaacauggccgaggugcgcagcuacugcuaugaagcuagcauuuccgacauggccagcgauuccagaugucccacgcaaggggaggcuuaccucgacaagcagucugacacccaguauguuugcaaacggacacugguggaucgcggauggggcaauggcugugggcuguucggaaagggcagccucgugaccugcgccaaauuugccugcuccaagaaaaugacagggaagucuauccagccugaaaaccuggaguacagaauuaugcuuucugugcacggaucccaacacagcggcaugaucguuaaugacaccgggcaugaaacggaugagaaccgggcuaagguggagaucacacccaauucuccgagagcggaagccacccugggaggcuucggcagccucgggcuggacugugagccucgcaccggacuugauuuuuccgaccuguauuaccucacaaugaacaauaaacacuggcugguccauaaggaaugguuccacgauauuccccugccuuggcacgcuggcgccgacaccgggacaccccauuggaacaauaaagaggcccucguggaauuuaaggaugcucacgccaaacggcagacggucgugguucugggaucucaggagggcgcggugcauaccgcucuugccggggcccuggaggcugaaauggacggcgccaagggaagacucagcuccggccaccugaaaugccgccuuaagauggauaagcugcggcucaaaggggucagcuauucucuguguacagcugccuucaccuuuacaaagaucccggcggagacccugcauggaacggugaccguugaagugcaguacgccggcacagacgggccuugcaaaguccccgcucaaauggccguggacaugcagacccucacaccugugggaagacugauuaccgcuaaccccguuaucacggaguccacagaaaacagcaagaugaugcuugagcuggaucccccuuucggcgacucuuacauugucaucggggugggcgagaaaaagaucacccaccacuggcaucgcuccggaagcacaauuggcaaggccuuugaagcgaccgugagaggggccaaacggauggcuguccucggagauaccgccugggacuucggcuccgucgggggagcucuuaauucucugggcaaggggauccaccagauuuucggcgccgccuuuaaaagccuguucggaggcauguccugguuuucucaaauccucauugggacacugcugauguggcucggacugaacacgaagaauggcagcaucucccuuaugugucuggcucucgggggaguucugaucuuccugagcaccgcggugucugccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9004 - RNA, 2290 nt, Artificial Sequence
  KY075932.1 prME-short mRNA Design 3 opt
gggagaaagcuuaccaugaccagcgugggcaucgucgggcugcuccugacaacggccauggcugccgagguuaccagacggggauccgcguacuauauguaccuugaccgcaacgaugcuggcgaagccauuucuuuccccacaacccuggggaugaauaagugcuauauccagauuauggaccucggacacaugugugaugccacaaugagcuacgagugcccuaugcuggacgaaggcguggagccggaugacguggauuguuggugcaacaccacauccaccugggucguguaugggacgugucaucacaaaaagggagaagcuagacggucucgcagagccguuacccuucccagccauuccacacggaaacugcaaacccgcucucagacauggcucgagagcagagaguacaccaagcaccugauccggauugaaaauuggaucuuucgcaacccuggcuucgcucuggccgcggccgcuaucgccuggcuccugggcuccagcacgucucagaaagugauuuaucuugucaugauccugcucauugcucccgccuacuccaucagaugcauuggggugagcaaucgggacuuuguugagggaaugucuggcgggacauggguggaugucgugcuggaacauggaggcugugugaccgucauggcgcaggacaagccuacaguugauaucgagcuugugaccaccacaguguccaacauggccgagguccgcagcuacugcuaugaagcuagcauuuccgacauggccagcgauuccagaugucccacgcaaggggaggcuuaccuggacaagcagucugacacccaguaugugugcaaacggacacucguugaucgcggauggggcaauggcugugggcuguucggaaagggcagccuggugaccugcgccaaauuugccugcuccaagaaaaugacagggaagucuauccagccugaaaaccucgaguacagaaucaugcugucuguccacggaucccaacacagcggcaugauugugaaugacaccgggcaugaaacggaugagaaccgggcuaagguugagaucacacccaauucuccgagagcggaagccacccuuggaggcuucggcagccuggggcucgacugugagccucgcaccggacuggauuuuuccgaccuuuauuaccugacaaugaacaauaaacacuggcucgugcauaaggaaugguuccacgauauuccccugccuuggcacgcuggcgccgacaccgggacaccccauuggaacaauaaagaggcccuggucgaauuuaaggaugcucacgccaaacggcagacgguggucgugcucggaucucaggagggcgcgguucauaccgcucuggccggggcccuugaggcugaaauggacggcgccaagggaagacugagcuccggccaccucaaaugccgccugaagauggauaagcugcggcugaaaggggugagcuauucucucuguacagcugccuucaccuuuacaaagaucccggcggagacccugcauggaacggucaccguggaaguucaguacgccggcacagacgggccuugcaaagugcccgcucaaauggccgucgacaugcagacccugacaccugugggaagacucauuaccgcuaaccccgugaucacggaguccacagaaaacagcaagaugaugcuggagcuugaucccccuuucggcgacucuuacaucguuauuggggucggcgagaaaaagaucacccaccacuggcaucgcuccggaagcacaauuggcaaggccuuugaagcgaccgugagaggggccaaacggauggcugugcugggagauaccgccugggacuucggcuccgucgggggagcucucaauucucugggcaaggggauccaccagauuuucggcgccgccuuuaaaagccuguucggaggcauguccugguuuucucaaauccuuaucgggacacuccugauguggcugggacucaacacgaagaauggcagcauuucccugaugugucuugcucuugggggagugcucaucuuccugagcaccgcgguuucugccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9005 - RNA, 2290 nt, Artificial Sequence
  KU870645.1 prME-short mRNA Design 3 opt
gggagaaagcuuaccaugaccagcgugggcaucgucgggcugcuccugacaacggccauggcugccgagguuaccagacggggauccgcguacuauauguaccuugaccgcaacgaugcuggcgaagccauuucuuuccccacaacccuggggaugaauaagugcuauauccagauuauggaccucggacacaugugugaugccacaaugagcuacgagugcccuaugcuggacgaaggcguggagccggaugacguggauuguuggugcaacaccacauccaccugggucguguaugggacgugucaucacaaaaagggagaagcuagacggucucgcagagccguuacccuucccagccauuccacacggaaacugcaaacccgcucucagacauggcucgagagcagagaguacaccaagcaccugauccggguggaaaauuggauucugcgcaacccuggcuuugcucucgccgcggccgcuaucgccuggcugcuuggcuccagcacgucucagaaagucaucuaucuggugaugauucuccugaucgcucccgccuacuccauuagaugcaucgggguuagcaaucgggacuucguggagggaaugucuggcgggacaugggucgauguggugcuugaacauggaggcugugucaccguuauggcgcaggacaagccuacaguggauauugagcuggugaccaccacagucuccaacauggccgaggugcgcagcuacugcuaugaagcuagcaucuccgacauggccagcgauuccagaugucccacgcaaggggaggcuuaccucgacaagcagucugacacccaguauguuugcaaacggacacugguggaucgcggauggggcaauggcugugggcuguuuggaaagggcagccucgugaccugcgccaaauucgccugcuccaagaaaaugacagggaagucuauucagccugaaaaccuggaguacagaaucaugcuuucuguccacggaucccaacacagcggcaugaucguuaaugacaccgggcaugaaacggaugagaaccgggcuaagguggagauuacacccaauucuccgagagcggaagccacccugggaggcuuuggcagccucgggcuggacugugagccucgcaccggacuugauuucuccgaccuguauuaccucacaaugaacaauaaacacuggcugguccauaaggaaugguuucacgauaucccccugccuuggcacgcuggcgccgacaccgggacaccccauuggaacaauaaagaggcccucguggaguucaaggaugcucacgccaaacggcagacggucgugguucugggaucucaggaaggcgcggugcauaccgcucuugccggggcccuggaggcugaaauggacggcgccaagggaagacucagcuccggccaccugaaaugccgccuuaagauggauaagcugcggcucaaaggggucagcuauucucuguguacagcugccuuuaccuucacaaagauuccggcggagacccugcauggaacggugaccguugaagugcaguacgccggcacagacgggccuugcaaaguccccgcucaaauggccguggacaugcagacccucacaccugugggaagacugaucaccgcuaaccccguuauuacggaguccacagaaaacagcaagaugaugcuugagcuggaucccccuuuuggcgacucuuacaucgucaucgggauuggcgagaaaaagaucacccaccacuggcaucgcuccggaagcacaauuggcaaggccuucgaagcgaccgugagaggggccaaacggauggcugugcucggagauaccgccugggacuuuggcuccgucgggggagcucuuaauucucugggcaaggggauccaccagauuuucggcgccgccuucaaaagccuguuuggaggcauguccugguucucucaaauccucaucgggacacugcugauguggcucggacugaacacgaagaauggcagcauuucccuuaugugucuggcucucgggggagugcugaucuuucugagcaccgcgguuucugccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9006 - RNA, 2290 nt, Artificial Sequence
  KU729217.2 prME-short mRNA Design 3 opt
gggagaaagcuuaccaugaccagcgugggcaucgucgggcugcuccugacaacggccauggcugccgagguuaccagacggggauccgcguacuauauguaccuugaccgcaacgaugcuggcgaagccauuucuuuccccacaacccuggggaugaauaagugcuauauccagauuauggaccucggacacaugugugaugccacaaugagcuacgagugcccuaugcuggacgaaggcguggagccggaugacguggauuguuggugcaacaccacauccaccugggucguguaugggacgugucaucacaaaaagggagaagcuagacggucucgcagagccguuacccuucccagccauuccacacggaaacugcaaacccgcucucagacauggcucgagagcagagaguacaccaagcaccugauccggguggaaaauuggauuuuucgcaacccuggcuucgcucuggccgcggccgcuaucgccuggcuccugggcuccagcacgucucagaaagucaucuaucuugugaugauucugcucaucgcucccgccuacuccauuagaugcaucgggguuagcaaucgggacuuuguggagggaaugucuggcgggacaugggucgauguggugcuggaacauggaggcugugucaccguuauggcgcaggacaagccuacaguggauauugagcuuguguccaccaccgucagcaacauggccgaggugcgcucuuacugcuaugaagcuacaaucuccgacauugccagcgauuccagaugucccacgcaaggggaggcuuaccuggacaagcagucugacacccaguauguuugcaaacggacacucguggaucgcggauggggcaauggcugugggcuguucggaaagggcagccuggugaccugcgccaaauuugccugcuccaagaaaaugacagggaagucuauccagccugaaaaccucgaguacagaaucaugcugucuguccacggaucccaacacagcggcaugauuguuaaugacaccgggcaugaaacggaugagaaccgggcuaagguggagaucacaccgaauagccccagagcggaagccacccuuggaggcuucggcagccuggggcucgacugugagccucgcaccggacuggauuuuuccgaccuuuauuaccugacaaugaacaauaaacacuggcucguccauaaggaaugguuccacgauauuccccugccuuggcacgcuggcgccgacaccgggacaccccauuggaacaauaaagaggcccugguggaauuuaaggaugcucacgccaaacggcagacggcggucgugcucggaucucaggagggcgcuguucauaccgcccuggccggggcucuugaggccgaaauggacggcgcuaagggaagacugagcuccggccaccucaaaugccgccugaagauggauaagcugcggcugaaaggggugagcuauucucucuguacagccgcguucaccuuuacaaagaucccggccgagacccugcauggaacggucaccguggaaguucaguacgcuggcacagacgggccuugcaaagugcccgcccaaauggcugucgacaugcagacccugacaccugugggaagacucauuaccgccaaccccgugaucacggaguccacagaaaacagcaagaugaugcuggagcuugaucccccuuucggcgacucuuacaucguuauuggggucggcgagaaaaagaucacccaccacuggcaucgcuccggaagcacaauuggcaaggcguuugaagccaccgugagaggggcuaaacggauggccgugcugggagauaccgcuugggacuucggcuccgucgggggagcccucaauucucugggcaaggggauccaccagauuuucggcgccgcuuuuaaaagccuguucggaggcauguccugguuuucucaaauccuuaucgggacacuccugauguggcugggacucaacacgaagaauggcagcauuucccugaugugucuugcgcuugggggagugcucaucuuccugagcaccgccguuucugcuugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9007 - RNA, 2290 nt, Artificial Sequence
  KX087101.3 prME-short mRNA Design 3 opt
gggagaaagcuuaccaugaccagcgugggcaucgucgggcugcuccugacaacggccauggcugccgagguuaccagacggggauccgcguacuauauguaccuugaccgcaacgaugcuggcgaagccauuucuuuccccacaacccuggggaugaauaagugcuauauccagauuauggaccucggacacaugugugaugccacaaugagcuacgagugcccuaugcuggacgaaggcguggagccggaugacguggauuguuggugcaacaccacauccaccugggucguguaugggacgugucaucacaaaaagggagaagcuagacggucucgcagagccguuacccuucccagccauuccacacggaaacugcaaacccgcucucagacauggcucgagagcagagaguacaccaagcaccugauccggguggaaaauuggauuuuucgcaacccuggcuucgcucuggccgcggccgcuaucgccuggcuccugggcuccagcacgucucagaaagucaucuaucuugugaugauucugcucaucgcucccgccuacuccauuagaugcaucgggguuagcaaucgggacuuuguggagggaaugucuggcgggacaugggucgauguggugcuggaacauggaggcugugucaccguuauggcgcaggacaagccuacaguggauauugagcuugugaccaccacagucuccaacauggccgaggugcgcagcuacugcuaugaagcuagcaucuccgacauggccagcgauuccagaugucccacgcaaggggaggcuuaccuggacaagcagucugacacccaguauguuugcaaacggacacucguggaucgcggauggggcaauggcugugggcuguucggaaagggcagccuggugaccugcgccaaauuugccugcuccaagaaaaugacagggaagucuauucagccugaaaaccucgaguacagaaucaugcugucuguccacggaucccaacacagcggcaugaucguuaaugacaccgggcaugaaacggaugagaaccgggcuaagguggagauuacacccaauucuccgagagcggaagccacccuuggaggcuucggcagccuggggcucgacugugagccucgcaccggacuggauuuuuccgaccuuuauuaccugacaaugaacaauaaacacuggcucguccauaaggaaugguuccacgauaucccccugccuuggcacgcuggcgccgacaccgggacaccccauuggaacaauaaagaggcccugguggaauuuaaggaugcucacgccaaacggcagacggucgugguucucggaucucaggagggcgcggugcauaccgcucuggccggggcccuugaggcugaaauggacggcgccaagggaagacugagcuccggccaccucaaaugccgccugaagauggauaagcugcggcugaaaggggucagcuauucucucuguacagcugccuucaccuuuacaaagauuccggcggagacccugcauggaacggugaccguugaacugcaguacgccggcacagacgggccuugcaaagugcccgcucaaauggccgucgacaugcagacccucacaccugugggaagacugaucaccgcuaaccccgugauuacggaguccacagaaaacagcaagaugaugcuugagcuggaucccccuuucggcgacucuuacaucguuaucggggucggcgagaaaaagauuacccaccacuggcaucgcuccggaagcacaaucggcaaggccuuugaagcgaccgugagaggggccaaacggauggcugugcucggagauaccgccugggacuucggcuccgucgggggagcucuuaauucucugggcaaggggauucaccagaucuucggcgccgccuuuaaaagccuuuucggaggcauguccugguuuucucaaauucucaucgggacacugcugauguggcucggacugaacacgaagaauggcagcaucucccuuaugugucuggcucucgggggagugcugauuuuccugagcaccgcgguuucugccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9008 - RNA, 2290 nt, Artificial Sequence
  KY014317.1 prME-short mRNA Design 3 opt
gggagaaagcuuaccaugaccagcgugggcaucgucgggcugcuccugacaacggccauggcugccgagguuaccagacggggauccgcguacuauauguaccuugaccgcaacgaugcuggcgaagccauuucuuuccccacaacccuggggaugaauaagugcuauauccagauuauggaccucggacacaugugugaugccacaaugagcuacgagugcccuaugcuggacgaaggcguggagccggaugacguggauuguuggugcaacaccacauccaccugggucguguaugggacgugucaucacaaaaagggagaagcuagacggucucgcagagccguuacccuucccagccauuccacacggaaacugcaaacccgcucucagacauggcucgagagcagagaguacaccaagcaccugauccggguggaaaauuggauuuuucgcaacccuggcuucgcucuggccgcggccgcuaucgccuggcuccugggcuccagcacgucucagaaagucaucuaucuugugaugauucugcucaucgcucccgccuacuccauuagaugcaucgggguuagcaaucgggacuuuguggagggaaugucuggcgggacaugggucgauguggugcuggaacauggaggcugugucaccguuauggcgcaggacaagccuacaguggauauugagcuugugaccaccacagucuccaacauggccgaggugcgcagcuacugcuaugaagcuagcaucuccgacauggccagcgauuccagaugucccacgcaaggggaggcuuaccuggacaagcagucugacacccaguauguuugcaaacggacacucguggaucgcggauggggcaauggcugugggcuguucggaaagggcagccuggugaccugcgccaaauuugccugcuccaagaaaaugacagggaagucuauucagccugaaaaccucgaguacagaaucaugcugucugugcacggaucccaacacagcggcaugaucguuaaugacaccgggcaugaaacggaugagaaccgggcuaagguggagauuacacccaauucuccgagagcggaagccacccuuggaggcuucggcagccuggggcucgacugugagccucgcaccggacuggauuuuuccgaccuuuauuaccugacaaugaacaauaaacacuggcucguccauaaggaaugguuccacgauaucccccugccuuggcacgcuggcgccgacaccgggacaccccauuggaacaauaaagaggcccugguggaauuuaaggaugcucacgccaaacggcagacggucgugguucucggaucucaggagggcgcggugcauaccgcucuggccggggcccuugaggcugaaauggacggcgccaagggaagacugagcuccggccaccucaaaugccgccugaagauggauaagcugcggcugaaaggggucagcuauucucucuguacagcugccuucaccuuuacaaagauuccggcggagacccugcauggaacggugaccguugaagugcaguacgccggcacagacgggccuugcaaaguccccgcucaaauggccguggacaugcagacccugacaccugugggaagacucaucaccgcuaaccccguuauuacggaguccaucgaaaacagcaagaugaugcuggagcuugaucccccuuucggcgacucuuacaucgucauuggggugggcgagaaaaagaucacacaccacuggcaucgcuccggaagcaccauuggcaaggccuuugaagcgacagugagaggggccaaacggauggcuguccugggagauaccgccugggacuucggcuccgucgggggagcucucaauucucugggcaaggggauccaccagauuuucggcgccgccuuuaaaagccuguucggaggcauguccugguuuucucaaauccuuaucgggacccuccugauguggcugggacucaacacaaagaauggcagcauuucccugaugugucuugcucuugggggaguucucaucuuccugagcacggcggugucugccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9009 - RNA, 2290 nt, Artificial Sequence
  KU758876.1 prME-short mRNA Design 3 opt
gggagaaagcuuaccaugaccagcgugggcaucgucgggcugcuccugacaacggccauggcugccgagguuaccagacggggauccgcguacuauauguaccuugaccgcaacgaugcuggcgaagccauuucuuuccccacaacccuggggaugaauaagugcuauauccagauuauggaccucggacacaugugugaugccacaaugagcuacgagugcccuaugcuggacgaaggcguggagccggaugacguggauuguuggugcaacaccacauccaccugggucguguaugggacgugucaucacaaaaagggagaagcuagacggucucgcagagccguuacccuucccagccauuccacacggaaacugcaaacccgcucucagacauggcucgagagcagagaguacaccaagcaccugauccggguggaaaauuggauuuuucgcaacccuggcuucgcucuggccgcggccgcuaucgccuggcuccugggcuccagcacgucucagaaagucaucuaucuugugaugauucugcucaucgcucccgccuacuccauuagaugcaucgggguuagcaaucgggacuuuguggagggaaugucuggcgggacaugggucgauguggugcuggaacauggaggcugugucaccguuauggcgcaggacaagccuacaguggauauugagcuugugaccaccacagucuccaacauggccgaggugcgcagcuacugcuaugaagcuagcaucuccgacauggccagcgauuccagaugucccacgcaaggggaggcuuaccuggacaagcagucugacacccaguauguuugcaaacggacacucguggaucgcggauggggcaauggcugugggcuguucggaaagggcagccuggugaccugcgccaaauuugccugcuccaagaaaaugacagggaagucuauucagccugaaaaccucgaguacagaaucaugcugucuguccacggaucccaacacagcggcaugaucguuaaugacaccgggcaugaaacggaugagaaccgggcuaagguggagauuacacccaauucuccgagagcggaagccacccuuggaggcuucggcagccuggggcucgacugugagccucgcaccggacuggauuuuuccgaccuuuauuaccugacaaugaacaauaaacacuggcucguccauaaggaaugguuccacgauaucccccugccuuggcacgcuggcgccgacaccgggacaccccauuggaacaauaaagaggcccugguggaauuuaaggaugcucacgccaaacggcagacggucgugguucucggaucucaggagggcgcggugcauaccgcucuggccggggcccuugaggcugaaauggacggcgucaagggaagacugagcuccggccaccucaaaugccgccugaagauggauaaacuucggcugaagggggugagcuauucucucuguacagccgcuuucaccuuuacaaagauuccggccgagacccugcauggaacgguuaccguggaaguccaguacgcgggcacagacgggccuugcaaagugcccgcccaaauggcuguggacaugcagacccugacaccuguuggaagacucaucaccgccaaccccgucauuacggaguccacagaaaacagcaagaugaugcuggagcuugaucccccuuucggcgacucuuacaucgugaucggggugggcgagaaaaagauuacccaccacuggcaucgcuccggaagcacaaucggcaaggcuuuugaagccaccgucagaggggcgaaacggauggccgugcugggagauaccgcuugggacuucggcuccguugggggagcccucaauucucugggcaaggggauucaccagaucuucggcgcugccuuuaaaagccuguucggaggcauguccugguuuucucaaauucuuaucgggacacuccugauguggcugggacucaacacgaagaauggcagcaucuccuucaugugucuggcccuugggggagugcugauuuuucucagcaccgcugucucugcgugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9010 - RNA, 2290 nt, Artificial Sequence
  KU758874.1 prME-short mRNA Design 3 opt
gggagaaagcuuaccaugaccagcgugggcaucgucgggcugcuccugacaacggccauggcugccgagguuaccagacggggauccgcguacuauauguaccuugaccgcaacgaugcuggcgaagccauuucuuuccccacaacccuggggaugaauaagugcuauauccagauuauggaccucggacacaugugugaugccacaaugagcuacgagugcccuaugcuggacgaaggcguggagccggaugacguggauuguuggugcaacaccacauccaccugggucguguaugggacgugucaucacaaaaagggagaagcuagacggucucgcagagccguuacccuucccagccauuccacacggaaacugcaaacccgcucucagacauggcucgagagcagagaguacaccaagcaccugauccggguggaaaauuggauuuuucgcaacccuggcuucgcucuggccgcggccgcuaucgccuggcuccugggcuccagcacgucucagaaagucaucuaucuugugaugauucugcucaucgcucccgccuacuccauuagaugcaucgggguuagcaaucgggacuuuguggagggaaugucuggcgggacaugggucgauguggugcuggaacauggaggcugugucaccguuauggcgcaggacaagccuacaguggauauugagcuugugaccaccacagucuccaacauggccgaggugcgcagcuacugcuaugaagcuagcaucuccgacauggccagcgauuccagaugucccacgcaaggggaggcuuaccuggacaagcagucugacacccaguauguuugcaaacggacacucguggaucgcggauggggcaauggcugugggcuguucggaaagggcagccuggugaccugcgccaaauuugccugcuccaagaaaaugacagggaagucuauucagccugaaaaccucgaguacagaaucaugcugucugugcacggaucccaacacagcggcaugaucguuaaugacaccgggcaugaaacggaugagaaccgggcuaagguggagauuacacccaauucuccgagagcggaagccacccuuggaggcuucggcagccuggggcucgacugugagccucgcaccggacuggauuuuuccgaccuuuauuaccugacaaugaacaauaaacacuggcucguccauaaggaaugguuccacgauaucccccugccuuggcacgcuggcgccgacaccgggacaccccauuggaacaauaaagaggcccugguggaauuuaaggaugcucacgccaaacggcagacggucgugguucucggaucucaggagggcgcggugcauaccgcucuggccggggcccuugaggcugaaauggacggcgccaagggaaaacugagcuccggccaccucaagugcagacugaagauggauaaacuucgccugaagggggucagcuauucucucuguacagcugccuucaccuuuacaaaaauuccggcggagacccugcauggaacggugaccguugaagugcaguacgccggcacagacgggccuugcaagguccccgcucaaauggccguggacaugcagacccugacaccugugggacggcucaucaccgcuaaccccguuauuacggaguccacagaaaacagcaaaaugaugcuggagcuugaucccccuuucggcgacucuuacaucgucaucggggugggcgagaagaagauuacccaccacuggcauagauccggaagcacaaucggcaaagccuuugaagcgaccgugcgcggggccaagcggauggcuguccugggagauaccgccugggacuucggcuccgucgggggagcucucaauucucugggcaaagggauucaccagaucuucggcgccgccuuuaagagccuguucggaggcauguccugguuuucucaaauucuuaucgggacacuccugauguggcugggacucaacacgaaaaauggcagcaucucccugaugugucuugcucucgggggaguucugauuuuccugagcaccgcggugucugccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9011 - RNA, 2290 nt, Artificial Sequence
  KY317939.1 prME-short mRNA Design 3 opt
gggagaaagcuuaccaugaccagcgugggcaucgucgggcugcuccugacaacggccauggcugccgagguuaccagacggggauccgcguacuauauguaccuugaccgcaaggaugcuggcgaagccauuucuuuccccacaacccuggggaugaacaaaugcuauauccagauuauggaccucggacacaugugugaugccacaaugagcuacgagugcccuaugcuggacgaaggcguggagccggaugacguggauuguuggugcaauaccacauccaccugggucguguaugggacgugucaucacaagaaaggagaagcuagacggucucgcagagccguuacccuucccagccauuccacacggaagcugcaaacccgcucucagacauggcucgagagcagagaguacaccaaacaccugauccggguggaaaacuggauuuuucgcaauccuggcuucgcucuggccgcggccgcuaucgccuggcuccugggcuccagcacgucucagaaggucaucuaucuugugaugauucugcucaucgcucccgccuacuccauuagaugcaucgggguuagcaaccgggacuuuguggagggaaugucuggcgggacaugggucgauguggugcuggaacauggaggcugugucaccguuauggcgcaggacaagccuacaguggauauugagcuugugaccaccacagucuccaauauggccgaggugcgcagcuacugcuaugaagcuagcaucuccgacauggccagcgauuccagaugucccacgcaaggggaggcuuaccuggacaaacagucugacacccaguauguuugcaagcggacacucguggaucgcggauggggcaacggcugugggcuguucggaaaaggcagccuggugaccugcgccaaguuugccugcuccaaaaagaugacagggaagucuauucagccugaaaaucucgaguacagaaucaugcugucugugcacggaucccaacacagcggcaugaucguuaacgacaccgggcaugaaacggaugagaaucgggcuaaaguggagauuacaccgaacucucccagagcggaagccacccuuggaggcuucggcagccuggggcucgacugugagccucgcaccggacuggauuuuuccgaccuuuauuaccugacaaugaauaacaagcacuggcucguccauaaagaaugguuccacgauaucccccugccuuggcacgcuggcgccgacaccgggacaccccauuggaauaacaaggaggcccugguggaauuuaaagaugcucacgccaagcggcagacggucgugguucucggaucucaggagggcgcggugcauaccgcucuggccggggcccuugaggcugaaauggacggcgccaaaggaagacugagcuccggccaccucaagugccgccugaagauggauaaacuucggcugaagggggucagcuauucucucuguacagcugccuucaccuuuacaaaaauuccggcggagacccugcauggaacggugaccguugaagugcaguacgccggcacagacgggccuugcaagguccccgcucaaauggccguggacaugcagacccugacaccugugggaagacucaucaccgcuaaucccguuauuacggaguccacagaaaacagcaaaaugaugcuggagcuugaucccccuuucggcgacucuuacaucgucaucggggugggcgagaagaagauuacccaccacuggcaucgcuccggaagcacaaucggcaaagccuuugaagcgaccgugagaggggccaagcggauggcuguccugggagauaccgccugggacuucggcuccgucgggggagcucucaacucucugggcaaagggauucaccagaucuucggcgccgccuuuaagagccuguucggaggcauguccugguuuucucaaauucuuaucgggacacuccugauguggcugggacucaauacgaaaaacggcagcaucucccugaugugucuugcucucgggggaguucugauuuuccugagcaccgcggugucugccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9012 - RNA, 2290 nt, Artificial Sequence
  KY014314.1 prME-short mRNA Design 3 opt
gggagaaagcuuaccaugaccagcgugggcaucgucgggcugcuccugacaacggccauggcugccgagguuaccagacggggauccgcguacuauauguaccuugaccgcaacgaugcuggcgaagccauuucuuuccccacaacccuggggaugaauaagugcuauauccagauuauggaccucggacacaugugugaugccacaaugagcuacgagugcccuaugcuggacgaaggcguggagccggaugacguggauuguuggugcaacaccacauccaccugggucguguaugggacgugucaucacaaaaagggagaagcuagacggucucgcagagccguuacccuucccagccauuccacacggaaacugcaaacccgcucucagacauggcucgagagcagagaguacaccaagcaccugauccggguggaaaauuggauuuuucgcaacccuggcuucgcucuggccgcggccgcuaucgccuggcuccugggcuccagcacgucucagaaagucaucuaucuugugaugauucugcucaucgcucccgccuacuccauuagaugcaucgggguuagcaaucgggacuuuguggagggaaugucuggcgggacaugggucgauguggugcuggaacauggaggcugugucaccguuauggcgcaggacaagccuacaguggauauugagcuugugaccaccacagucuccaacauggccgaggugcgcagcuacugcuaugaagccucuaucuccgacauggcuagcgauuccagaugucccacgcaaggggaggcuuaccuggacaagcagucugacacccaguauguuugcaaacggacacucguggaucgcggauggggcaauggcugugggcuguucggaaagggcagccuggugaccugcgccaaauuugccugcuccaagaaaaugacaggaaagagcauucagccugaaaaccucgaguacagaaucaugcugucugugcacgggucccaacacagcggcaugaucguuaaugacaccgggcaugaaacggaugagaaccgggcuaagguggagauuacacccaauucucccagagcggaagccacccuuggaggcuucggcagccuggggcucgacugugagccucgcaccggacuggauuuuuccgaccuuuauuaccugacaaugaacaauaaacacuggcucguccauaaggaaugguuccacgauaucccccugccuuggcacgcuggcgccgacaccgggacaccccauuggaacaauaaagaggcccugguggaauuuaaggaggcucacgccaaacggcagacggucgugguucucggaucucaggagggcgcggugcauaccgcucuggccggggcccuugaagcugagauggauggcgccaagggaagacugagcuccggccaccucaaaugccgccugaagauggacaaacuucggcugaaaggggucagcuauucucucuguacagcugccuucaccuuuacaaagauuccggcggaaacccugcauggaacggugaccguugaggugcaguacgccggcacagaugggccuugcaaaguccccgcucaaauggccguggacaugcagacccugacaccugugggaagacucaucaccgcuaaccccguuauuacggaauccacagagaacagcaagaugaugcuggagcuugacccgccuuucggcgauucuuacaucgucaucggggugggcgaaaagaagauuacccaccacuggcaucgcuccggaagcacaaucggcaaggccuuugaggcgaccgugagaggggccaaacggauggcuguccugggagacaccgccugggauuucggcuccgucgggggagcucucaauucucugggcaaggggauucaccagaucuucggcgccgccuuuaaaagccuguucggaggcauguccugguuuucucaaauucuuaucgggacacuccugauguggcugggacucaacacgaagaauggcagcaucucccugaugugucuugcucucgggggaguucugauuuuccugagcaccgcggugucugccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9013 - RNA, 2290 nt, Artificial Sequence
  KX447517.1 prME-short mRNA Design 3 opt
gggagaaagcuuaccaugaccagcgugggcaucgucgggcugcuccugacaacggccauggcugccgagguuaccagacggggauccgcguacuauauguaccuugaccgcaacgaugcuggcgaagccauuucuuuccccacaacccuggggaugaauaagugcuauauccagauuauggaccucggacacaugugugaugccacaaugagcuacgagugcccuaugcuggacgaaggcguggagccggaugacguggauuguuggugcaacaccacauccaccugggucguguaugggacgugucaucacaaaaagggagaagcuagacggucucgcagagccguuacccuucccagccauuccacacggaaacugcaaacccgcucucagacauggcucgagagcagagaguacaccaagcaccugauccggguggaaaauuggauuuuucgcaacccuggcuucgcucuggccgcggccgcuaucgccuggcuccugggcuccagcacgucucagaaagucaucuaucuugugaugauucugcucaucgcucccgccuacuccauuagaugcaucgggguuagcaaucgggacuuuguggagggaaugucuggcgggacaugggucgauguggugcuggaacauggaggcugugucaccguuauggcgcaggacaagccuacaguggauauugagcuugugaccaccacagucuccaacauggccgaggugcgcagcuacugcuaugaagccucuaucuccgacauggcuagcgauuccagaugucccacgcaaggggaggcuuaccuggacaagcagucugacacccaguauguuugcaaacggacacucguggaucgcggauggggcaauggcugugggcuguucggaaagggcagccuggugaccugcgccaaauuugccugcuccaagaaaaugacaggaaagagcauucagccugaaaaccucgaguacagaaucaugcugucugugcacgggucccaacacagcggcaugaucguuaaugacaccgggcaugaaacggaugagaaccgggcuaagguggagauuacacccaauucucccagagcggaagccgcucuuggaggcuucggcagccuggggcucgacugugagccucgcaccggacuggauuuuuccgaccuuuauuaccugaccaugaacaauaaacacuggcucguccauaaggaaugguuccacgauaucccccugccuuggcacgccggcgccgacacagggaccccgcauuggaacaauaaagaggcucugguggaauuuaaggaugcccacgcgaaacggcagacagucgugguucucggaucucaggagggcgcugugcauacggcccuggccggggcucuugaggccgaaauggacggcgcuaagggaagacugagcuccggccaccucaaaugccgccugaagauggauaagcugcggcugaaaggggucagcuauucucucuguaccgccgcguucacauuuaccaagauuccggccgagacacugcauggaaccgugacgguugaagugcaguacgcuggcaccgacgggccuugcaaaguccccgcccaaauggcuguggacaugcagacacugaccccugugggaagacucaucacagccaaccccguuauuaccgaguccacggaaaacagcaagaugaugcuggagcuugaucccccuuucggcgacucuuacaucgucaucggggugggcgagaaaaagauuacacaccacuggcaucgcuccggaagcaccaucggcaaggcguuugaagccacagugagaggggcuaaacggauggccguccugggagauaccgcuugggacuucggcuccgucgggggagcccucaauucucugggcaaggggauucaccagaucuucggcgccgcuuuuaaaagccuguucggaggcauguccugguuuucucaaacccuuauugggacacuccugauguggcugggacucaacacgaagaauggcagcaucucccugaugugucuugcgcuugggggaguucucaucuuccugagcaccgccgugucugcuugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9014 - RNA, 2290 nt, Artificial Sequence
  KU926310.1 prME-short mRNA Design 3 opt
gggagaaagcuuaccaugaccagcgugggcaucgucgggcugcuccugacaacggccauggcugccgagguuaccagacggggauccgcguacuauauguaccuugaccgcaacgaugcuggcgaagccauuucuuuccccacaacccuggggaugaauaagugcuauauccagauuauggaccucggacacaugugugaugccacaaugagcuacgagugcccuaugcuggacgaaggcguggagccggaugacguggauuguuggugcaacaccacauccaccugggucguguaugggacgugucaucacaaaaagggagaagcuagacggucucgcagagccguuacccuucccagccauuccacacggaaacugcaaacccgcucucagacauggcucgagagcagagaguacaccaagcaccugauccggguggaaaauuggauuuuucgcaacccuggcuucgcucuggccgcggccgcuaucgccuggcuccugggcuccagcacgucucagaaagucaucuaucuugugaugauucugcucaucgcucccgccuacuccauuagaugcaucgggguuagcaaucgggacuuuguggagggaaugucuggcgggacaugggucgauguggugcuggaacauggaggcugugucaccguuauggcgcaggacaagccuacaguggauauugagcuugugaccaccacagucuccaacauggccgaggugcgcagcuacugcuaugaagcuagcaucuccgacauggccagcgauuccagaugucccacgcaaggggaggcuuaccuggacaagcagucugacacccaguauguuugcaaacggacacucguggaucgcggauggggcaauggcugugggcuguucggaaagggcagccuggugaccugcgccaaauuugccugcuccaagaaaaugacagggaagucuauucagccugaaaaccucgaguacagaaucaugcugucugugcacggaucccaacacagcggcaugaucguuaaugacaccgggcaugaaacggaugagaaccgggcuaagguggagauuacacccaauucuccgagagcggaagccacccuuggaggcuucggcagccuggggcucgacugugagccucgcaccggacuggauuuuuccgaccuuuauuaccugacaaugaacaauaaacacuggcucguccauaaggaaugguuccacgauaucccccugccuuggcacgcuggcgccgacaccgggacaccccauuggaacaauaaagaggcccugguggaauuuaaggaugcucacgccaaacggcagacggucgugguucucggaucucaggagggcgcggugcauaccgcucuggccggggcccuugaggcugaaauggacggcgccaagggaagacugagcuccggccaccucaaaugccgccugaagauggauaagcugcggcugaaaggggucagcuauucucucuguacagcugccuucaccuuuacaaagauuccggcggagacccugcauggaacggugaccguugaagugcaguacgccggcgcugacgggccuugcaaaguccccgcccaaauggcuguggacaugcagacacugaccccugugggaagacucaucacagccaaccccguuauuaccgaguccacggaaaacagcaagaugaugcuggagcuugaucccccuuucggcgacucuuacaucgucaucggggugggcgagaaaaagauuacacaccacuggcaucgcuccggaagcaccaucggcaaggcguuugaagccacagugagaggggcuaaacggauggccguccugggagauaccgcuugggacuucggcuccgucgggggagcccucaauucucugggcaaggggauucaccagaucuucggcgccgcuuuuaaaagccuguucggaggcauguccugguuuucucaaauucuuaucgggacccuccugauguggcugggacucaacacaaagaauggcagcaucucccugaugugucuugcgcuugggggaguucucauuuuccugagcacggccgugucugcuugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9015 - RNA, 2290 nt, Artificial Sequence
  KU922923.1 prME-short mRNA Design 3 opt
gggagaaagcuuaccaugaccagcgugggcaucgucgggcugcuccugacaacggccauggcugccgagguuaccagacggggauccgcguacuauauguaccuugaccgcaacgaugcuggcgaagccauuucuuuccccacaacccuggggaugaauaagugcuauauccagauuauggaccucggacacaugugugaugccacaaugagcuacgagugccccaugcuggacgaaggcguggagccggaugacguggauuguuggugcaacaccacauccaccugggucguguaugggacgugucaucacaaaaagggagaagcuagacggucucgcagagccguuacccuucccagccauuccacacggaaacugcaaacccgcucucagacauggcucgagagcagagaguacaccaagcaccugauccggguggaaaauuggauuuuucgcaacccuggcuucgcucuggccgcggccgcuaucgccuggcuccugggcuccagcacgucucagaaagucaucuaucuugugaugauucugcucaucgcucuggccuacuccauuagaugcaucgggguuagcaaucgggacuuuguggagggaaugucuggcgggacaugggucgauguggugcuugaacauggaggcugugucaccguuauggcgcaggacaagcccacaguggauauugagcuggugaccaccacagucuccaacauggccgaggugcgcagcuacugcuaugaagcuagcaucuccgacauggccagcgauuccagauguccuacgcaaggggaggcuuaccucgacaagcagucugacacccaguauguuugcaaacggacacugguggaucgcggauggggcaauggcugugggcuguucggaaagggcagccucgugaccugcgccaaauuugccugcuccaagaaaaugacagggaagucuauucagcccgaaaaccuggaguacagaaucaugcuuucugugcacggaucccaacacagcggcaugaucguuaaugacaccgggcaugaaacggaugagaaccgggcuaagguggagauuacaccuaauucuccgagagcggaagccacccugggaggcuucggcagccucgggcuggacugugagccccgcaccggacuugauuuuuccgaccuguauuaccucacaaugaacaauaaacacuggcugguccauaaggaaugguuccacgauaucccucugcccuggcacgcuggcgccgacaccgggacaccucauuggaacaauaaagaggcccucguggaauuuaaggaugcucacgccaaacggcagacggucgugguucugggaucucaggagggcgcggugcauaccgcucuugccggggcccuggaggcugaaauggacggcgccaagggaagacucagcuccggccaccugaaaugccgccuuaagauggauaagcugcggcucaaaggggucagcuauucucuguguacagcugccuucaccuuuacaaagauucccgcggagacccugcauggaacggugaccguugaagugcaguacgccggcacagacgggccgugcaaagucccugcucaaauggccguggacaugcagacccucacacccgugggaagacugaucaccgcuaacccuguuauuacggaguccacagaaaacagcaagaugaugcuugagcuggauccucccuucggcgacucuuacaucgucaucggggugggcgagaaaaagauuacccaccacuggcaucgcuccggaagcacaaucggcaaggccuuugaagcgaccgugagaggggccaaacggauggcuguccucggagauaccgccugggacuucggcuccgucgggggagcucuuaauucucugggcaaggggauucaccagaucuucggcgccgccuuuaaaagccuguucggaggcauguccugguuuucucaaauucucaucgggacacugcugauguggcucggacugaacacgaagaauggcagcaucucccuuaugugucuggcucucgggggaguucugauuuuccugagcaccgcggugucugccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9016 - RNA, 2290 nt, Artificial Sequence
  KY075937.1 prME-short mRNA Design 3 opt
gggagaaagcuuaccaugaccagcgugggcaucgucgggcugcuccugacaacggccauggcugccgagguuaccagacggggauccgcguacuauauguaccuugaccgcaacgaugcuggcgaagccauuucuuuccccacaacccuggggaugaauaagugcuauauccagauuauggaccucggacacaugugugaugccacaaugagcuacgagugcccuaugcuggacgaaggcguggagccggaugacguggauuguuggugcaacaccacauccaccugggucguguaugggacgugucaucacaaaaagggagaagcuagacggucucgcagagccguuacccuucccagccauuccacacggaaacugcaaacccgcucucagacauggcucgagagcagagaguacaccaagcaccugauccggguggaaaauuggauuuuucgcaacccuggcuucgcucuggccgcggccgcuaucgccuggcuccugggcuccagcacgucucagaaagucaucuaucuugugaugauucugcucaucgcucccgccuacuccauuagaugcaucgggguuagcaaucgggacuuuguggagggaaugucuggcgggacaugggucgauguggugcuggaacauggaggcugugucaccguuauggcgcaggacaagccuacaguggauauugagcuugugaccaccacagucuccaacauggccgaggugcgcagcuacugcuaugaagcuagcaucuccgacaugguuagcgauuccagaugucccacgcaaggggaggccuaccuggacaagcagucugacacccaguaugugugcaaacggacacucgucgaucgcggauggggcaauggcugugggcuguucggaaagggcagccuggugaccugcgcuaaauuugccugcuccaagaaaaugacagggaagucuauucagccugaaaaccucgaguacagaaucaugcugucuguucacggaucccaacacagcggcaugaucgugaaugacaccgggcaugaaacggaugagaaccgggccaaggucgagauuacacccaauucuccgagagcugaagcgacccuuggaggcuucggcagccuggggcucgacugugagccucgcaccggacuggauuuuuccgaccuuuauuaccugacaaugaacaauaaacacuggcucgugcauaaggaaugguuccacgauaucccccugccuuggcacgccggcgcugacaccgggacaccccauuggaacaauaaagaggcccuggucgaauuuaaggaugcccacgcuaaacggcagacggugguugugcucggaucucaggagggcgccguccauaccgcgcuggcuggggcccuugaggccgaaauggacggcgcuaagggaagacugagcuccggccaccucaaaugccgccugaagauggauaagcugcggcugaaaggggugagcuauucucucuguacagccgcuuucaccuuuacaaagauuccggccgagacccugcauggaacgguuaccguggaaguccaguacgcgggcacagacgggccuugcaaagugcccgcccaaauggcuguggacaugcagacccugacaccuguuggaagacucaucaccgccaaccccgucauuacggaguccacagaaaacagcaagaugaugcuggagcuugaucccccuuucggcgacucuuacaucgugaucggggugggcgagaaaaagauuacccaccacuggcaucgcuccggaagcacaaucggcaaggcuuuugaagccaccgucagaggggcgaaacggauggccgugcugggagauaccgcuugggacuucggcuccguugggggagcccucaauucucugggcaaggggauucaccagaucuucggcgcugccuuuaaaagccuguucggaggcauguccugguuuucucaaauucuuaucgggacacuccugauguggcugggacucaacacgaagaauggcagcaucucccugaugugucuugcccuugggggagugcucauuuuccugagcaccgcugucucugcgugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9017 - RNA, 2290 nt, Artificial Sequence
  KY003156.1 prME-short mRNA Design 3 opt
gggagaaagcuuaccaugaccagcgugggcaucgucgggcugcuccugacaacggccauggcugccgagguuaccagacggggauccgcguacuauauguaccuugaccgcaacgaugcuggcgaagccauuucuuuccccacaacccuggggaugaauaagugcuauauccagauuauggaccucggacacaugugugaugccacaaugagcuacgagugcccuaugcuggacgaaggcguggagccggaugacguggauuguuggugcaacaccacauccaccugggucguguaugggacgugucaucacaaaaagggagaagcuagacggucucgcagagccguuacccuucccagccauuccacacggaaacugcaaacccgcucucagacauggcucgagagcagagaguacaccaagcaccugauccggguggaaaauuggauuuuucgcaacccuggcuucgcucuggccgcggccgcuaucgccuggcuccugggcuccagcacgucucagaaagucaucuaucuugugaugauucugcucaucgcucccgccuacuccauuagaugcaucgggauuagcaaucgggacuuuguugagggaaugucuggcgggacauggguggaugucgugcuggaacauggaggcugugugaccgucauggcgcaggacaagccuacaguugauaucgagcuugugaccaccacaguguccaacauggccgagguccgcagcuacugcuaugaagcuagcauuuccgacauggccagcgauuccagaugucccacgcaaggggaggcuuaccuggacaagcagucugacacccaguaugugugcaaacggacacucguugaucgcggauggggcaauggcugugggcuguucggaaagggcagccuggugaccugcgccaaauuugccugcuccaagaaaaugacagggaagucuauccagccugaaaaccucgaguacagaaucaugcugucuguccacggaucccaacacagcggcaugauugugaaugacaccgggcaugaaacggaugagaaccgggcuaagguugagaucacacccaauucuccgagagcggaagccacccuuggaggcuucggcauucuggggcucgacugugagccucgcaccggacuggauuuuagcgaccuuuauuaccugacaaugaacaauaaacacuggcucgugcauaaggaaugguuccacgauaucccccugccuuggcacgcuggcgccgacaccgggacaccccauuggaacaauaaagaggcccuggucgaauuuaaggaugcucacgccaaacggcagacgguggucgugcucggaucccaggagggcgcgguucauaccgcucuggccggggcccuugaggcugaaauggacggcgccaagggaagacugucuagcggccaccucaaaugccgccugaagauggauaagcugcggcugaaagggguguccuauagccucuguacagcugccuucaccuuuacaaagauuccggcggagacccugcauggaacggucaccguggaaguucaguacgccggcacagacgggccuugcaaagugcccgcucaaauggccgucgacaugcagacccugacaccugugggaagacucaucaccgcuaaccccgugaucacggagucuacagaaaacuccaagaugaugcuggagcuugaucccccuuucggcgacagcuacauuguuaucggggucggcgagaaaaagauuacccaccacuggcaucgcucuggauccacaaucggcaaggccuuugaagcgaccgugagaggggccaaacggauggcugugcugggagauaccgccugggacuucggcagcgucgggggagcucucaauucccugggcaaggggauucaccagaucuucggcgccgccuuuaaaucucuguucggaggcaugagcugguuuucccaaauccuuauugggacacuccugauguggcugggacucaacacgaagaauggcucuaucagccugaugugucuugcucuugggggagugcucauuuuccuguccaccgcgguuagcgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9018 - RNA, 2290 nt, Artificial Sequence
  KU312313.1 prME-short mRNA Design 3 opt
gggagaaagcuuaccaugaccagcgugggcaucgucgggcugcuccugacaacggccauggcugccgagguuaccagacggggauccgcguacuauauguaccuugaccgcaacgaugcuggcgaagccauuucuuuccccacaacccuggggaugaauaagugcuauauccagauuauggaccucggacacacaugugaugccaccaugagcuacgagugcccuaugcuggacgaaggcguggagccggaugacguggauuguuggugcaacacaaccuccacgugggucguguaugggaccugucaucacaaaaagggagaagcuagacggucucgcagagccguuacacuucccagccauuccauccggaaacugcaaacccgcucucagacauggcucgagagcagagaguacaccaagcaccugauucggguggaaaauuggaucuuucgcaacccuggcuucgcucuggccgcggccgcuaucgccuggcuccugggcuccagcacgucucagaaagucauuuaucuugugaugauccugcucauugcucccgccuacuccaucagaugcauugggguuagcaaucgggacuuuguggagggaaugucuggcgggacaugggucgauguggugcuggaacauggaggcugugucaccguuauggcgcaggacaagccuacaguggauaucgagcuugugaccaccacagucuccaacauggccgaggugcgcagcuacugcuaugaagcuagcauuuccgacauggccagcgauuccagaugucccacgcaaggggaggcuuaccuggacaagcagucugacacccaguauguuugcaaacggacacucguggaucgcggauggggcaauggcugugggcuguucggaaagggcagccuggugaccugcgccaaauuugccugcuccaagaaaaugacagggaagucuauccagccugaaaaccucgaguacagaaucaugcugucugugcacggaucccaacacagcggcaugauuguuaaugacaccgggcaugaaacggaugagaaccgggcuaagguggagaucacacccaauucuccgagagcggaagccacccuuggaggcuucggcagccuggggcucgacugugagccucgcaccggacuggauuuuuccgaccuuuauuaccugacaaugaacaauaaacacuggcucguccauaaggaaugguuccacgauauuccccugccuuggcacgcuggcgccgacaccgggacaccccauuggaacaauaaagaggcccugguggaauuuaaggaugcucacgccaaacggcagacggucgugguucucggaucucaggagggcgcggugcauaccgcucuggccggggcccuugaggcugaaauggacggcgccaagggaagacugagcuccggccaccucaaaugccgccugaagauggauaagcugcggcugaaaggggucagcuauucucucuguacagcugccuucaccuuuacaaagaucccggcggagacccugcauggaacggugaccguugaagugcaguacgccggcacagacgggccuugcaaaguccccgcucaaauggccguggacaugcagacccugacaccugugggaagacucauuaccgcuaaccccguuaucacggaguccacagaaaacagcaagaugaugcuggagcuugaucccccuuucggcgacucuuacaucgucauuggggugggcgagaaaaagaucacccaccacuggcaucgcuccggaagcacaauuggcaaggccuuugaagcgaccgugagaggggccaaacggauggcuguccugggagauaccgccugggacuucggcuccgucgggggagcucucaauucucugggcaaggggauccaccagauuuucggcgccgccuuuaaaagccuguucggaggcauguccugguuuucucaaauccuuaucgggacacuccugauguggcugggacucaacgcuaagaauggcagcauuucccugaugugucuugcgcuugggggaguucucaucuuccugagcacggccgugucugcuugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9019 - RNA, 2290 nt, Artificial Sequence
  KY075935.1 prME-short mRNA Design 3 opt
gggagaaagcuuaccaugaccagcgugggcaucgucgggcugcuccugacaacggccauggcugccgagguuaccagacggggauccgcguacuauauguaccuugaccgcaacgaugcuggcgaagccauuucuuuccccacaacccuggggaugaauaagugcuauauccagauuauggaccucggacacaugugugaugccacaaugagcuacgagugcccuaugcuggacgaaggcguggagccggaugacguggauuguuggugcaacaccacauccaccugggucguguaugggacgugucaucacaaaaagggagaagcucaaagaucucggcgcgccguuacccuucccagccauuccacaagaaaacugcagacccggucucagacauggcucgagagccgcgaguacaccaagcaccugaucagaguggaaaauuggauuuuucggaacccuggcuucgcucuggccgcggccgcuaucgccuggcuccugggcuccagcacgucucagaaagucaucuaucuugugaugauucugcucaucgcucccgccuacuccauucgcugcaucgggguuagcaauagagacuuuguggagggaaugucuggcgggacaugggucgauguggugcuggaacauggaggcugugucaccguuauggcgcaagacaagccuacaguggauauugagcuugugaccaccacagucuccaacauggccgaggugcggagcuacugcuaugaagcuagcaucuccgacauggccagcgauucccgcugucccacgcagggggaggcuuaccuggacaagcagucugacacccaguauguuugcaaaagaacacucguggaucggggauggggcaauggcugugggcuguucggaaagggcagccuggugaccugcgccaaauuugccugcuccaagaaaaugacagggaagucuauucaaccugaaaaccucgaguaccgcaucaugcugucugugcacggaucccagcacagcggcaugaucguuaaugacaccgggcaugaaacggaugagaacagagcuaagguggagauuacacccaauucuccgcgggcggaagccacccuuggaggcuucggcagccuggggcucgacugugagccuagaaccggacuggauuuuuccgaccuuuauuaccugacaaugaacaauaaacacuggcucguccauaaggaaugguuccacgauaucccccugccuuggcacgcuggcgccgacaccgggacaccccauuggaacaauaaagaggcccugguggaauuuaaggaugcucacgccaaacgccagacggucgugguucucggaucucaggagggcgcggugcauaccgcucuggccggggcccuugaggcugaaauggacggcgccaagggacggcugagcuccggccaccucaaaugcagacugaagauggauaagcugcgccugaaaggggucagcuauucucucuguacagcugccuucaccuuuacaaagauuccggcggagacccugcauggaacggugaccguugaagugcaauacgccggcacagacgggccuugcaaaguccccgcucagauggccguggacaugcagacccugacaccugugggacggcucaucaccgcuaaccccguuauuacggaguccacagaaaacagcaagaugaugcuggagcuugaucccccuuucggcgacucuuacaucgucaucggggugggcgagaaaaagauuacccaccacuggcauagauccggaagcacaaucggcaaggccuuugaagcgaccgugcgcggggccaaacggauggcuguccugggagauaccgccugggacuucggcuccgucgggggagcucucaauucucugggcaaggggauucaccaaaucuucggcgccgccuuuaaaagccuguucggaggcauguccugguuuucucagauucuuaucgggacacuccugauguggcugggacucaacacgaagaauggcagcaucucccugaugugucuugcucuugggggaguucucauuuuccugagcaccgcggugucugccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9020 - RNA, 2290 nt, Artificial Sequence
  KY014320.1 prME-short mRNA Design 3 opt
gggagaaagcuuaccaugaccagcgugggcaucgucgggcugcuccugacaacggccauggcugccgagguuaccagacggggauccgcguacuauauguaccuugaccgcaacgaugcuggcgaagccauuucuuuccccacaacccuggggaugaauaagugcuauauccagauuauggaccucggacacaugugugaugccacaaugagcuacgagugcccuaugcuggacgaaggcguggagccggaugacguggauuguuggugcaacaccacauccaccugggucguguaugggacgugucaucacaaaaagggagaagcuagacggucucgcagagccguuacccuucccagccauuccacacggaaacugcaagcucgcucucagaccuggcucgagagcagagaguacacaaagcaccugauccggguggaaaauuggauuuuucgcaacccuggcuucgcccuggcggccgcugccaucgcuuggcuccugggcuccagcaccucucagaaagucaucuaucuugugaugauucugcucaucgcccccgcguacuccauuagaugcaucgggguuagcaaucgggacuuuguggagggaaugucuggcgggacgugggucgauguggugcuggaacauggaggcugugucacaguuauggcccaggacaagccuaccguggauauugagcuugugacaaccaccgucuccaacauggcugaggugcgcagcuacugcuaugaagccucuaucuccgacauggcuagcgauuccagaugucccacacaaggggaggccuaccuggacaagcagucugacacgcaguauguuugcaaacggacccucguggaucgcggauggggcaauggcugugggcuguucggaaagggcagccuggucacaugcgccaaauuugcuugcuccaagaaaaugaccggaaagagcauucagccugaaaaccucgaguacagaaucaugcugucugugcacgggucccaacacagcggcaugaucguuaaugacacagggcaugaaaccgaugagaaccgggcgaagguggagauuacgcccaauucucccagagccgaagcuacacuuggaggcuucggcagccuggggcucgacugugagccucgcaccggacuggauuuuuccgaccuuuauuaccugaccaugaacaauaaacacuggcucguccauaaggaaugguuccacgauaucccccugccuuggcacgccggcgccgacacagggaccccgcauuggaacaauaaagaggcucugguggaauuuaaggaugcccacgcgaaacggcagacagucgugguucucggaucucaggagggcgcugugcauacggcccuggccggggcucuugaggccgaaauggacggcgcuaagggaagacugagcuccggccaccucaaaugccgccugaagauggauaagcugcggcugaaaggggucagcuauucucucuguaccgccgcguucacauuuaccaagauuccggccgagacacugcauggaaccgugacgguugaagugcaguacgcuggcaccgacgggccuugcaaaguccccgcccaaauggcuguggacaugcagacacugaccccugugggaagacucaucacagccaaccccguuauuaccgaguccacggaaaacagcaagaugaugcuggagcuugaucccccuuucggcgacucuuacaucgucaucggggugggcgagaaaaagauuacacaccacuggcaucgcuccggaagcaccaucggcaaggcguuugaagccacagugagaggggcuaaacggauggccguccugggagauaccgcuugggacuucggcuccguugggggagcccucaauucucugggcaaggggauucaccagaucuucggcgccgcuuuuaaaagccuguucggaggcauguccugguuuucucaaauucuuaucgggacccuccugauguggcugggacucaacacaaagaauggcagcaucucccugaugugucuugcgcuugggggagugcucauuuuccugagcacggccgugucugcuugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9021 - RNA, 2290 nt, Artificial Sequence
  KY328290.1 prME-short mRNA Design 3 opt
gggagaaagcuuaccaugaccagcgugggcaucgucgggcugcuccugacaacggccauggcugccgagguuaccagacggggauccgcguacuauauguaccuugaccgcucugaugcuggcgaagccauuagcuuccccacaacccuggggaugaacaagugcuauauccagauuauggaccucggacacaugugugaugccacaauguccuacgagugcccuaugcuggacgaaggcguggagccggaugacguggauuguuggugcaauaccacaucuaccugggucguguaugggacgugucaucacaaaaagggagaagcuagacggagccgcagagccguuacccuucccucccauucuacacggaaacugcaaacccgcagccagacauggcucgaguccagagaguacaccaagcaccugauccggguggaaaacuggauuuuucgcaauccuggcuucgcucuggccgcggccgcuaucgccuggcuccugggcagcucuacgucccagaaagucaucuaucuugugaugauucugcucaucgcucccgccuacagcauuagaugcaucgggguuucuaaccgggacuuuguggagggaauguccggcgggacaugggucgauguggugcuggaacauggaggcugugucaccguuauggcgcaggacaagccuacaguggauauugagcuugugaccaccacagucagcaauauggccgaggugcgcucuuacugcuaugaagccuccaucagcgacauggcuuccgauucuagaugucccacgcaaggggaggcuuaccuggacaagcagagcgacacccaguauguuugcaaacggacacucguggaucgcggauggggcaacggcugugggcuguucggaaagggcucccuggugaccugcgccaaauuugccugcagcaagaaaaugacagggaagucuauucagccugaaaaucucgaguacagaaucaugcuguccguccacggaagccaacacucuggcaugaucguuaacgacaccgggcaugaaacggaugagaaucgggcuaagguggagauuacaccgaacagccccagagcggaagccacccuuggaggcuucggcucccuggggcucgacugugagccucgcaccggacuggauuuuucugaccuuuauuaccugacaaugaauaacaaacacuggcucguccauaaggaaugguuccacgauaucccccugccuuggcacgcuggcgccgacaccgggacaccccauuggaauaacaaagaggcccugguggaauuuaaggaugcucacgccaaacggcagacggucgugguucucggaagccaggagggcgcggugcauaccgcucuggccggggcccuugaggcugaaauggacggcgccaagggaagacuguccagcggccaccucaaaugccgccugaagauggauaaacuucggcugaaaggggucucuuauucccucuguacagcugccuucaccuuuagcaagauuccggcggagacacugcauggaaccgugacggaagagguucaguacgccggcaccgacgggccuugcaaagugcccgcucaaauggccgucgacaugcagacacugaccccugugggaagacucaucacagcuaaucccgugauuaccgaaucuacggagaacuccaagaugaugcuggagcuugaucccccuuucggcgacagcuacaucguuaucggggucggcgaaaagaagauuacacaccacuggcaucgcuccggaucuaccaucggcaaggccuuugaggcgacagugagaggggccaaacggauggcugugcugggagauaccgccugggacuucggcagcgucgggggagcucucaacucccugggcaaggggauucaccagaucuucggcgccgccuuuaaaucucuguucggaggcaugagcugguuuucccaaauucuuaucgggacccuccugauguggcugggacucaauacaaagaacggcagcaucucucugaugugucuugcucucgggggagugcugauuuuccuguccacggcgguuagcgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9022 - RNA, 2290 nt, Artificial Sequence
  KU681081.3 prME-short mRNA Design 3 opt
gggagaaagcuuaccaugaccagcgugggcaucgucgggcugcuccugacaacggccauggcugccgagguuaccagacggggauccgcguacuauauguaccuugaccgcucugaugcuggcgaagccauuagcuuccccacaacccuggggaugaacaagugcuauauccagauuauggaccucggacacaugugugaugccacaauguccuacgagugcccuaugcuggacgaaggcguggagccggaugacguggauuguuggugcaauaccacaucuaccugggucguguaugggacgugucaucacaaaaagggagaagcuagacggagccgcagagccguuacccuucccucccauucuacacggaaacugcaaacccgcagccagacauggcucgaguccagagaguacaccaagcaccugauccggguggaaaacuggauuuuucgcaauccuggcuucgcucuggccgcggccgcuaucgccuggcuccugggcagcucuacgucccagaaagucaucuaucuugugaugauucugcucaucgcucccgccuacagcauuagaugcaucgggguuucuaaccgggacuuuguggagggaauguccggcgggacaugggucgauguggugcuggaacauggaggcugugucaccguuauggcgcaggacaagccuacaguggauauugagcuugugaccaccacagucagcaauauggccgaggugcgcucuuacugcuaugaagccuccaucagcgacauggcuuccgauucuagaugucccacgcaaggggaggcuuaccuggacaagcagagcgacacccaguauguuugcaaacggacacucguggaucgcggauggggcaacggcugugggcuguucggaaagggcucccuggugaccugcgccaaauuugccugcagcaagaaaaugacagggaagucuauucagccugaaaaucucgaguacagaaucaugcuguccguccacggaagccaacacucuggcaugaucguuaacgacaccgggcaugaaacggaugagaaucgggcuaagguggagauuacaccgaacagccccagagcggaagccacccuuggaggcuucggcucccuggggcucgacugugagccucgcaccggacuggauuuuucugaccuuuauuaccugacaaugaauaacaaacacuggcucguccauaaggaaugguuccacgauaucccccugccuuggcacaccggcgcugacacagggacgccccauuggaauaacaaagaggcccugguggaauuuaaggaugcccacgcuaaacggcagaccgucgugguucucggaagccaggagggcgccgugcauacagcgcuggcuggggcccuugaggccgaaauggacggcgcuaagggaagacuguccagcggccaccucaaaugccgccugaagauggauaaacuucggcugaagggggucucuuauucccucuguaccgccgcuuucacauuuaccaagauuccggccgagacgcugcauggaaccgugacaguugaagugcaguacgcgggcaccgacgggccuugcaaaguccccgcccaaauggcuguggacaugcagacacugaccccugugggaagacucaucacggccaaucccguuauuacagagggcaccgaaaacagcaagaugaugcuggagcuugaucccccuuucggggacucuuacaucgucaucggcgugggagagaaaaagauuacacaccacuggcaucgcuccggcagcaccaucgggaaggcuuuugaagccaccgugcggggagcgaaaagaauggccguccugggcgauacagcuugggacuucggguccgugggaggcguucucaacucucuggggaagggcauucaccagaucuucggagccgcuuuuaaaagccuguucggcgggauguccugguuuucucaaauucuuaucggaacgcuccugauguggcugggccucaauaccaagaacgggagcaucucccugaugugucuugcccugggaggcgugcucauuuuccugagcacagccgucucugcuugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9023 - RNA, 2290 nt, Artificial Sequence
  KX827309.1 prME-short mRNA Design 3 opt
gggagaaagcuuaccaugaccagcgugggcaucgucgggcugcuccugacaacggccauggcugccgagguuaccagacggggauccgcguacuauauguaccuugaccgcucugaugcuggcgaagccauuagcuuccccacaacccuggggaugaacaagugcuauauccagauuauggaccucggacacaugugugaugccacaauguccuacgagugcccuaugcuggacgaaggcguggagccggaugacguggauuguuggugcaauaccacaucuaccugggucguguaugggacgugucaucacaaaaagggagaagcuagacggagccgcagagccguuacccuucccucccauucuacacggaaacugcaaacccgcagccagacauggcucgaguccagagaguacaccaagcaccugauccggguggaaaacuggauuuuucgcaauccuggcuucgcucuggccgcggccgcuaucgccuggcuccugggcagcucuacgucccagaaagucaucuaucuugugaugauucugcucaucgcucccgccuacagcauuagaugcaucgggguuucuaaccgggacuuuguggagggaauguccggcgggacaugggucgauguggugcuggaacauggaggcugugucaccguuauggcgcaggacaagccuacaguggauauugagcuugugaccaccacagucagcaauauggccgaggugcgcucuuacugcuaugaagccuccaucagcgacauggcuuccgauucuagaugucccacgcaaggggaggcuuaccuggacaagcagagcgacacccaguauguuugcaaacggacacucguggaucgcggauggggcaacggcugugggcuguucggaaagggcucccuggugaccugcgccaaauuugccugcagcaagaaaaugacagggaagucuauucagccugaaaaucucgaguacagaaucaugcuguccgugcacggaagccaacacucuggcaugaucguuaacgacaccgggcaugaaacggaugagaaucgggcuaagguggagauuacaccgaacagccccagagcggaagccacccuuggaggcuucggcucccuggggcucgacugugagccucgcaccggacuggauuuuucugaccuuuauuaccugacaaugaauaacaaacacuggcucguccauaaggaaugguuccacgauaucccccugccuuggcacgcuggcgccgacaccgggacaccccauuggaauaacaaagaggcccugguggaauuuaaggaugcucacgccaaacggcagacggucgugguucucggaagccaggagggcgcggugcauaccgcucuggccggggcccuugaggcugaaauggacggcgccaagggaagacuguccagcggccaccucaaaugccgccugaagauggauaagcugcggcugaaaggggucucuuauucccucuguacagcugccuucaccuuuacaaagauuccggcggagacccugcauggaacggugaccguugaagugcaguacgccggcacagacgggccuugcaaaguccccgcucaaauggccguggacaugcagacccugacaccugugggaagacucaucaccgcuaaucccguuauuacggagagcacagaaaacucuaagaugaugcuggagcuugaucccccuuucggcgacuccuacaucgucaucggggugggcgagaaaaagauuacccaccacuggcaucgcagcggauccacaaucggcaaggccuuugaagcgaccgugagaggggccaaacggauggcuguccugggagauaccgccugggacuucggcucugucgggggagcucucaacagccugggcaaggggauucaccagaucuucggcgccgccuuuaaaucccuguucggaggcaugucuugguuuagccaaauucuuaucgggacacuccugauguggcugggacucaauacgaagaacggcuccaucagccugaugugucuugcucuugggggaguucucauuuuccugucuaccgcgguguccgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9024 - RNA, 2290 nt, Artificial Sequence
  KU955593.1 prME-short mRNA Design 3 opt
gggagaaagcuuaccaugaccagcgugggcaucgucgggcugcuccugacaacggccauggcuguugaggugaccagacggggaaacgccuacuauauguaccuugaccgcuccgaugcgggcgaagcuauuucuuuccccacaaccauggggaugaauaagugcuauauccagauuauggaccugggacacaugugugaugccacaaugagcuacgagugcccuaugcucgacgaaggcguggagccggaugacgucgauuguuggugcaacaccacauccaccugggugguuuaugggacgugucaucacaaaaagggagaagccagacggucucgcagagcugugacccugcccagccauuccacacggaaacuucaaacccgcucucagacauggcuggagagcagagaguacaccaagcaccucauccgggucgaaaauuggauuuuucgcaacccuggcuucgcccuggcugccgcggccaucgcuuggcugcucggcuccagcacgucucagaaagugaucuaucugguuaugauucuucugaucgcccccgcuuacuccauuagaugcaucggggugagcaaucgggacuuugucgagggaaugucuggcgggacauggguggaugugguccucgaacauggaggcuguguuaccgugauggcccaggacaagccuacaguggauauugagcuggucaccaccacaguguccaacauggcggagguucgcagcuacugcuaugaagccucuaucuccgacauggcuagcgauuccagaugucccacgcaaggggaggccuaccuugacaagcagucugacacccaguaugugugcaaacggacacuggucgaucgcggauggggcaauggcugugggcuguucggaaagggcagccuggugaccugcgcuaaauuugccugcuccaagaaaaugacagggaagucuauucagccugaaaaccuggaguacagaaucaugcucucuguucacggaucccaacacagcggcaugaucgugaaugacaccgggcaugaaacggaugagaaccgggccaaggucgagauuacaccgaauagccccagagcugaagcgacccugggaggcuucggcagccuugggcuggacugugagccucgcaccggacucgauuuuuccgaccuguauuaccuuacaaugaacaauaaacacuggcuggugcauaaggaaugguuccacgauaucccccucccuuggcacgccggcgcugacaccgggacaccccauuggaacaauaaagaggcccuggucgaauuuaaggaugcccacgcuaaacggcagacggugguugugcugggaucucaggagggcgccguccauaccgcgcucgcuggggcccuggaggccgaaauggacggcgcuaagggaagacuuagcuccggccaccugaaaugccgccucaagauggauaagcugcggcuuaaaggggugagcuauucucuguguacagccgcuuucaccuuuacaaagauuccggccgagacccuccauggaacgguuaccguggaaguccaguacgcgggcacagacgggccuugcaaagugcccgcccaaauggcuguggacaugcagacccugacaccuguuggaagacugaucaccgccaaccccgucauuacggaguccacagaaaacagcaagaugaugcucgagcuggaucccccuuucggcgacucuuacaucgugaucggggugggcgagaaaaagauuacccaccacuggcaucgcuccggaagcacaaucggcaaggcuuuugaagccaccgucagaggggcgaaacggauggccgugcuuggagauaccgcuugggacuucggcuccguugggggagcccucaauucucucggcaaggggauucaccagaucuucggcgcugccuuuaaaagccuguucggaggcauguccugguuuucucaaauucugaucgggacacuucucguguggcugggacugaacacgaagaauggcagcaucucccucaugugucuggcccuugggggaguccugauuuuccucagcaccgcugugucugcgugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9025 - RNA, 2290 nt, Artificial Sequence
  KY272987.1 prME-short mRNA Design 3 opt
gggagaaagcuuaccaugaccagcgugggcaucgucgggcugcuccugacaacggccauggcugccgagguuaccagacggggauccgcguacuauauguaccuugaccgcucugaugcuggcgaagccauuagcuuccccacaacccuggggaugaacaagugcuauauccagauuauggaccucggacacaugugugaugccacaauguccuacgagugcccuaugcuggacgaaggcguggagccggaugacguggauuguuggugcaauaccacaucuaccugggucguguaugggacgugucaucacaaaaagggagaagcuagacggagccgcagagccguuacccuucccucccauucuacacggaaacugcaaacccgcagccagacauggcucgaguccagagaguacaccaagcaccugauccggguggaaaacuggauuuuucgcaauccuggcuucgcucuggccgcggccgcuaucgccuggcuccugggcagcucuacgucccagaaagucaucuaucuugugaugauucugcucaucgcucccgccuacagcauuagaugcaucgggguuucuaaccgggacuuuguggagggaauguccggcgggacaugggucgauguggugcuggaacauggaggcugugucaccguuauggcgcaggacaagccuacaguggauauugagcuugugaccaccacagucagcaauauggccgaggugcgcucuuacugcuaugaagccuccaucagcgacauggcuuccgauucuagaugucccacgcaaggggaggcuuaccuggacaagcagagcgacacccaguauguuugcaaacggacacucguggaucgcggauggggcaacggcugugggcuguucggaaagggcucccuggugaccugcgccaaauuugccugcagcaagaaaaugacagggaagucuauucagccugaaaaucucgaguacagaaucaugcuguccgugcacggaagccaacacucuggcaugaucguuaacgacaccgggcaugaaacggaugagaaucgggcuaagguggagauuacaccgaacagccccagagcggaagccacccuuggaggcuucggcucccuggggcucgacugugagccucgcaccggacuggauuuuucugaccuuuauuaccugacaaugaauaacaaacacuggcucguccauaaggaaugguuccacgauaucccccugccuuggcacgcuggcgccgacaccgggacaccccauuggaauaacaaagaggcccugguggaauuuaaggaugcucacgccaaacggcagacggucgugguucucggaagccaggagggcgcggugcauaccgcucuggccggggcccuugaggcugaaauggacggcgccaagggaagacuguccagcggccaccucaaaugccgccugaagauggauaagcugcggcugaaaggggucucuuauucccucuguacagcugccuucaccuuuacaaagauuccggcggagacccugcauggaacggugaccguugaagugcaguacgccggcacagacgggccuugcaaaguccccgcucaaauggccguggacaugcagacccugacaccugugggaagacucaucaccgcuaaucccguuauuacggagagcacagaaaacucuaagaugaugcuggagcuugaucccccuuucggcgacuccuacaucgucaucggggugggcgagaaaaagauuacccaccacuggcaucgcagcggauccacaaucggcaaggccuuugaagcgaccgugagaggggccaaacggauggcuguccugggagauaccgccugggacuucggcucugucgggggagcucucaacagccugggcaaggggauucaccagaucuucggcgccgccuuuaaaucccuguucggaggcaugucuugguuuagccaaauucuuaucgggacacuccugauguggcugggacucaauacgaagaacggcuccaucagccugguuugucuugcucuugggggagugcucauuuuccugucuaccgcggucuccgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9026 - RNA, 2290 nt, Artificial Sequence
  KY007221.1 prME-short mRNA Design 3 opt
gggagaaagcuuaccaugaccagcgugggcaucgucgggcugcuccugacaacggccauggcugccgagguuaccagacggggauccgcguacuauauguaccuugaccgcucugaugcuggcgaagccauuagcuuccccacaacccuggggaugaacaagugcuauauccagauuauggaccucggacacaugugugaugccacaauguccuacgagugcccuaugcuggacgaaggcguggagccggaugacguggauuguuggugcaauaccacaucuaccugggucguguaugggacgugucaucacaaaaagggagaagcuagacggagccgcagagccguuacccuucccucccauucuacacggaaacugcaaacccgcagccagacauggcucgaguccagagaguacaccaagcaccugauccggguggaaaacuggauuuuucgcaauccuggcuucgcucuggccgcggccgcuaucgccuggcuccugggcagcucuacgucccagaaagucaucuaucuugugaugauucugcucaucgcucccgccuacagcauuagaugcaucgggguuaacaaucgggacuuuguggagggaaugucuggcgggacaugggucgauguggugcuggaacauggaggcugugucaccguuauggcgcaggacaagccuacaguggauauugagcuugugaccaccacagucuccaacauggccgaggugcgcagcuacugcuaugaagcuagcaucuccgacauggccagcgauuccagaugucccacgcaaggggaggcuuaccuggacaagcagucugacacccaguauguuugcaaacggacacucguggaucgcggauggggcaauggcugugggcuguucggaaagggcagccuggugaccugcgccaaauuugccugcuccaagaaaaugacagggaagucuauucagccugaaaaccucgaguacagaaucaugcugucugugcacggaucccaacacagcggcaugaucguuaaugacaccgggcaugaaacggaugagaaccgggcuaagguggagauuacacccaauucuccgagagcggaagccacccuuggaggcuucggcagccuggggcucgacugugagccucgcaccggacuggauuuuuccgaccuuuauuaccugacaaugaacaauaaacacuggcucguccauaaggaaugguuccacgauaucccccugccuuggcacgcuggcgccgacaccgggacaccccauuggaacaauaaagaggcccugguggaauuuaaggaugcucacgccaaacggcagacggucgugguucucggaucucaggagggcgcggugcauaccgcucuggccggggcccuugaggcugaaauggacggcgccaagggaagacugagcuccggccaccucaaaugccgccugaagauggauaagcugcggcugaaaggggucagcuauucucucuguacagcugccuucaccuuuacaaagauuccggcggagacccugcauggaacggugaccguugaagugcaguacgccggcacagacgggccuugcaaaguccccgcucaaauggccguggacaugcagacccugacaccugugggaagacucaucaccgcuaaccccguuauuacggaguccacagaaaacagcaagaugaugcuggagcuugaucccccuuucggcgacucuuacaucgucaucggggugggcgagaaaaagauuacccaccacuggcaucgcuccggaagcacaaucggcaaggccuuugaagcgaccgugagaggggccaaacggauggcuguccugggagauaccgccugggacuucggcuccgucgggggagcucucaauucucugggcaaggggauucaccagaucuucggcgccgccuuuaaaagccuguucggaggcauguccugguuuucucaaauucuuaucgggacacuccugauguggcugggacucaacacgaagaauggcagcaucucccugguuugucuugcucuugggggagugcucauuuuccugagcaccgcggucucugccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9027 - RNA, 2290 nt, Artificial Sequence
  EU545988.1 prME-short mRNA Design 3 opt
gggagaaagcuuaccaugaccagcgugggcaucgucgggcugcuccugacaacggccauggcuguugaggugaccagacggggauccgccuacuauauguaccuugaccgcucugaugcgggcgaagcuauuagcuuccccacaacccuggggaugaacaagugcuauauccagauuauggaccucggacacaugugugaugccacaauguccuacgagugcccuaugcuggacgaaggcguggagccggaugacgucgauuguuggugcaauaccacaucuaccugggugguuuaugggacgugucaucacaaaaagggagaagccagacggagccgcagagcugugacccuucccucccauucuacacggaaacugcaaacccgcagccagacauggcucgaguccagagaguacaccaagcaccugauccgggucgaaaacuggauuuuucgcaauccuggcuucgcccuggcugccgcggccaucgcuuggcuccugggcagcucuacgucccagaaagugaucuaucuuguuaugauucugcucaucgcccccgcuuacagcauuagaugcaucggggugucuaaccgggacuuugucgagggaauguccggcgggacauggguggaugugguccuggaacauggaggcuguguuaccgugauggcccaggacaagccugcgguggauauugagcuugucacaaccaccgugagcaauauggccgagguucgcucuuacugcuaugaagccuccaucagcgacauggcuuccgauucuagaugucccacacaaggggaggcuuaccuggacaagcagagcgacacgcaguaugugugcaaacggacccucgucgaucgcggauggggcaacggcugugggcuguucggaaagggcucccuggugacaugcgccaaauuugccugcagcaagaaaaugaccgggaagucuauucagccugaaaaucucgaguacagaaucaugcuguccguucacggaagccaacacucuggcaugaucgugaacgacacagggcaugaaaccgaugagaaucgggcuaaggucgagauuacgccgaacagccccagagcggaagccacacuuggaggcuucggcucccuggggcucgacugugagccucgcaccggacuggauuuuucugaccuuuauuaccugaccaugaauaacaaacacuggcucgugcauaaggaaugguuccacgauaucccccugccuuggcacgcuggcgccgacacagggacaccccauuggaauaacaaagaggcccuggucgaauuuaaggaugcucacgccaaacggcagaccgugguugugcucggaagccaggagggcgcgguccauacggcucuggccggggcccuugaggcugaaauggacggcgccaagggaagacuguccagcggccaccucaaaugccgccugaagauggauaagcugcggcugaaaggggugucuuauucccucuguaccgcugccuucacauuuaccaagauuccggcggagacacugcauggaaccguuacgguggaaguccaguacgccggcaccgacgggccuugcaaagugcccgcucaaauggccguggacaugcagacacugaccccuguuggaagacucaucacagcuaaucccgucauuaccgagagcacggaaaacucuaagaugaugcuggagcuugaucccccuuucggcgacuccuacaucgugaucggggugggcgagaaaaagauuacacaccacuggcaucgcagcggauccaccaucggcaaggccuuugaagcgacagucagaggggccaaacggauggcugugcugggagauaccgccugggacuucggcucuguugggggagcucucaacagccugggcaaggggauucaccagaucuucggcgccgccuuuaaaucccuguucggaggcaugucuugguuuagccaaauucuuaucgggacccuccugguguggcugggacucaauacaaagaacggcuccaucagccugacgugucuugcucuugggggaguccucauuuuccugucuaccgcgguguccgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9028 - RNA, 2290 nt, Artificial Sequence
  KU681082.3 prME-short mRNA Design 3 opt
gggagaaagcuuaccaugaccagcgugggcaucgucgggcugcuccugacaacggccauggcuguugaggugaccagacggggauccgccuacuauauguaccuugaccgcucugaugcgggcgaagcuauuagcuuccccacaacccuggggaugaacaagugcuauauccagauuauggaccucggacacaugugugaugccacaauguccuacgagugcccuaugcuggacgaaggcguggagccggaugacgucgauuguuggugcaauaccacaucuaccugggugguuuaugggacgugucaucacaaaaagggagaagccagacggagccgcagagcugugacccuucccucccauucuacacggaaacugcaaacccgcagccagacauggcucgaguccagagaguacaccaagcaccugauccgggucgaaaacuggauuuuucgcaauccuggcuucgcccuggcugccgcggugaucgccuggcuccugggcagcucuacgucccagaaaguuaucuaucuugugaugauucugcucaucgcucccgccuacagcauuagaugcaucggggucucuaaccgggacuuuguggagggaauguccggcgggacauggguggaugucguucuggaacauggaggcugugugaccgugauggcucaggacaagccuacagucgauauugagcuugugaccaccacaguuagcaauauggccgaggugcgcucuuacugcuaugaagcguccaucagcgacauggccuccgauucuagaugucccacgcaaggggaggcuuaccuggacaagcagagcgacacccaguaugucugcaaacggacacucguggaucgcggauggggcaacggcugugggcuguucggaaagggcucccugguuaccugcgccaaauuugcuugcagcaagaaaaugacagggaagucuauucagccugaaaaucucgaguacagaaucaugcuguccgugcacggaagccaacacucuggcaugaucgucaacgacaccgggcaugaaacggaugagaaucgggccaagguggagauuacaccgaacagccccagagccgaagcuacccuuggaggcuucggcucccuggggcucgacugugagccucgcaccggacuggauuuuucugaccuuuauuaccugacaaugaauaacaaacacuggcucguccauaaggaaugguuccacgauaucccccugccuuggcacgcgggcgccgacaccgggacaccccauuggaauaacaaagaggcucugguggaauuuaaggaugcccacgccaaacggcagacgguugugguccucggaagccaggagggcgcugugcauaccgcccuggcgggggcucuugaggccgaaauggacggcgccaagggaagacuguccagcggccaccucaaaugccgccugaagauggauaagcugcggcugaaagggguuucuuauucccucuguacagcugccuucaccuuuacaaagauuccggcugagacccugcauggaacggugaccgucgaagugcaguacgccggcacagacgggccuugcaaagugcccgcgcaaauggccguugacaugcagacccugacaccugucggaagacucaucaccgcuaaucccgugauuacggagagcacagaaaacucuaagaugaugcuggagcuugaucccccuuucggcgacuccuacaucgugaucggggucggcgagaaaaagauuacccaccacuggcaucgcagcggauccacaaucggcaaggccuuugaagcuaccgugagaggggccaaacggauggcgguucugggagauaccgccugggacuucggcucugucgggggagcucucaacagccugggcaaggggauucaccagaucuucggcgccgcuuuuaaaucccuguucggaggcaugucuugguuuagccaaauucuuaucgggacacuccugguguggcugggacucaauacgaagaacggcuccaucagccugaccugucuugcccuugggggagugcucauuuuccugucuacagccguuuccgcuugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9029 - RNA, 2290 nt, Artificial Sequence
  KX601167.1 prME-short mRNA Design 3 opt
gggagaaagcuuaccaugaccagcgugggcaucgucgggcugcuccugacaacggccauggcuguugaggugaccagacggggauccgccuacuauauguaccuugaccgcucugaugcgggcgaagcuauuagcuuccccacaacccugggggugaacaagugcuauauccagauuauggaccucggacacaugugugaugccacaauguccuacgagugcccuaugcuggacgaaggcgucgagccggaugacguggauuguuggugcaauaccacaucuaccuggguuguguaugggacgugucaucacaaaaagggagaagccagacggagccgcagagcugucacccuucccucccauucuacacggaaacugcaaacccgcagccagacauggcucgaguccagagaguacaccaagcaccugauccggguggaaaacuggauuuuucgcaauccuggcuucgcccuggcugccgcggccaucgcuuggcuccugggcagcucuacgucccagaaaguuaucuaucuugugaugauucugcucaucgcccccgcuuacagcauuagaugcaucggggucucuaaccgggacuuuguggagggaauguccggcgggacauggguggaugucguucuggaacauggaggcugugugaccgugauggcccaggacaagccuacagucgauauugagcuugugaccaccacaguuagcaauauggcggaggugcgcucuuacugcuaugaagccuccaucagcgacauggcuuccgauucuagaugucccacgcaaggggaggccuaccuggacaagcagagcgacacccaguaugucugcaaacggacacucguggaucgcggauggggcaacggcugugggcuguucggaaagggcucccugguuaccugcgcuaaauuugccugcagcaagaaaaugacagggaagucuauucagccugaaaaucucgaguacagaaucaugcuguccgugcacggaagccaacacucuggcaugaucgucaacgacaccgggcaugaaacggaugagaaucgggccaagguggagauuacaccgaacagccccagagcugaagcgacccuuggaggcuucggcucccuggggcucgacugugagccucgcaccggacuggauuuuucugaccuuuauuaccugacaaugaauaacaaacacuggcucguccauaaggaaugguuccacgauaucccccugccuuggcacgccggcgcugacaccgggacaccccauuggaauaacaaagaggcccugguggaauuuaaggaugcccacgcuaaacggcagacgguugugguccucggaagccaggagggcgccgugcauaccgcgcuggcuggggcccuugaggccgaaauggacggcgcuaagggaagacuguccagcggccaccucaaaugccgccugaagauggauaagcugcggcugaaagggguuucuuauucccucuguacagccgcuuucaccuuuacaaagauuccggccgagacccugcauggaacggugaccgucgaagugcaguacgcgggcacagacgggccuugcaaagugcccgcccaaauggcuguugacaugcagacccugacaccugucggaagacucaucaccgccaaucccgugauuacggagagcacagaaaacucuaagaugaugcuggagcuugaucccccuuucggcgacuccuacaucgugaucggggucggcgauaaaaagauuacccaccacugguaucgcagcggauccacaaucggcaaggcuuuugaggccaccgugagaggggcgaaacggauggccguucugggagacaccgcuugggauuucggcucugucgggggagcccucaacagccugggcaaggggauucaucagaucuucggcgcugccuuuaaaucccuguucggaggcaugucuugguuuagccaaauucuuaucgggacacuccugguguggcugggacucaauacgaagaacggcuccaucagccugaccugucuugcccuugggggagugcucauuuuccugucuacagcuguuuccgcgugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9030 - RNA, 2290 nt, Artificial Sequence
  KX694533.2 prME-short mRNA Design 3 opt
gggagaaagcuuaccaugaccagcgugggcaucgucgggcugcuccugacaacggccauggcuguugaggugaccagacggggauccgccuacuauauguaccuugaccgcucugaugcgggcaaggcuauuagcuuccccacaacccugggggugaacaaaugcuauauccagauuauggaccucggacacaugugugaugccacaauguccuacgaaugcccuaugcuggacgagggcgucgaaccggaugacguggauuguuggugcaauaccacaucuaccuggguuguguaugggacgugucaucacaagaaaggagaggccagacggagccgcagagcugucacccuucccucccauucuacacggaagcugcaaacccgcagccagacauggcucgaauccagagaguacaccaaacaccugauccggguggagaacuggauuuuucgcaauccuggcuucgcccuggcugccgcggccaucgcuuggcuccugggcagcucuacgucccagaagguuaucuaucuugugaugauucugcucaucgcccccgcuuacagcauuagaugcaucggggucucuaaccgggacuuuguggaaggaauguccggcgggacauggguggaugucguucuggagcauggaggcugugugaccgugauggcccaggacaagccuacagucgauauugaacuugugaccaccacaguuagcaauauggcggaggugcgcucuuacugcuaugaggccuccaucagcgacauggcuuccgauucuagaugucccacgcaaggggaagccuaccuggacaaacagagcgacacccaguaugucugcaagcggacacucguggaucgcggauggggcaacggcugugggcuguucggaaaaggcucccugguuaccugcgcuaaguuugccugcagcaaaaagaugacagggaagucuauucagccugagaaucucgaauacagaaucaugcuguccgugcacggaagccaacacucuggcaugaucgucaacgacauugggcaugagaccgaugaaaaucgggccaaaguggagaucacgccgaacagccccagagcugaggcgacacuuggaggcuucggcucccuggggcucgacugugaaccucgcaccggacuggauuuuucugaccuuuauuaccugaccaugaauaacaagcacuggcucguccauaaagagugguuccacgauauuccccugccuuggcacgccggcgcugacacagggacaccccauuggaauaacaaggaagcccugguggaguuuaaagaugcccacgcuaagcggcagacaguugugguccucggaagccaggaaggcgccgugcauacggcgcuggcuggggcccuugaggccgagauggacggcgcuaaaggaagacuguccagcggccaccucaagugccgccugaagauggauaaacuucggcugaaggggguuucuuauucccucuguaccgccgcuuucacauuuaccaaaaucccggccgaaacacugcauggaaccgugacggucgaggugcaguacgcgggcaccgacgggccuugcaaggugcccgcccaaauggcuguugacaugcagacacugaccccugucggaagacucauuacagccaaucccgugaucaccgaaagcacggagaacucuaaaaugaugcuggaacuugaucccccuuucggcgacuccuacaucgugauuggggucggcgauaagaagaucacacaccacuggcaucgcagcggauccaccauuggcaaggcuuuugaggccacagugagaggggcgaaacggauggccguucugggagacaccgcuugggauuucggcucugucgggggagcccucaacagccugggcaaagggauccaccagauuuucggcgcugccuuuaagucccuguucggaggcaugucuugguuuagccaaauccuuaucgggacccuccugguguggcugggacucaauaccaaaaacggcuccauuagccugacgugucuugcccucgggggagugcugaucuuccugucuaccgcuguuuccgcgugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9031 - RNA, 2290 nt, Artificial Sequence
  KY288905.1 prME-short mRNA Design 3 opt
gggagaaagcuuaccaugaccagcaucggcauuguggggcugcuccugacaacggccauggcugccgagaucaccagacggggauccgcguacuauauguaccuugaccgcucugaugcuggcaaggccauuagcuucgccacaacccugggggucaacaaaugccacguucagaucauggaccucggacauaugugugaugcuacaauguccuaugaaugccccaugcuggacgagggcguggaacccgaugacguggauuguuggugcaauaccacaucuaccugggucguguacgggacgugucaccauaagaaaggagaggccagacggagccgcagagcuguuacccuuccgucccacucuacacggaagcugcaaacccgcagccagacauggcucgaauccagagaguauaccaaacaucugauuaagguggagaacuggaucuuucggaaucccggcuucacgcuggucgccguggcgaucgccuggcuccugggcagcucuacaucccagaagguuauuuaccuugugaugauccugcucauugcuccugccuauagcauccgcugcauuggggucucuaacagagacuuuguggaaggaauguccggcgggaccuggguggaugucguucuggagcacggaggcugugugacagugauggcucaggacaaacccaccgucgauaucgaacuugugaccacaacgguuagcaauauggccgaggugcggucuuacugcuacgaggcguccauuagcgacauggccuccgauucucgcuguccuacccaaggggaggcuuaucuggacaagcagagcgacacacaguacgucugcaaaagaacccucguggaucggggauggggcaacggcugugggcuguucggaaagggcucccugguuacaugcgccaaauuuaccugcagcaagaagaugacggggaaaucuauccagcccgaaaaucucgaauaucgcaucaugcuguccgugcacggaagccaacauucuggcaugauugucaacgacacagggcacgagaccgaugaaaauagagcuaagguggaggucaccccuaacagcccgcgggccgaggccacacuuggaggcuucggcucccuggggcucgacugugaacccagaaccggacuggauuuuucugaccuuuacuaucugacaaugaauaacaaacauuggcucgugcacaaggagugguuccacgauaucccucugcccuggcaugcuggcgcggacacggggaccccucacuggaauaacaaagaagcccugguugaguuuaaggaugcucaugccaaacgccagacaguggucgugcucggaagccaggaaggcgccguucacaccgcucuggccggggcgcuugaggcugagauggacggcgccaagggacggcuguucuccggccaucucaagugcagacugaaaauggauaaacuucgccugaagggggugagcuacucucucuguacagccgcuuuuaccuucacgaagguccccgccgaaacccugcacggaacagugaccguggagguucaguaugcuggcacagacgggccgugcaaagucccugcccaaauggcgguggacaugcagacccugacgcccgugggacggcucauuacagccaauccugucaucaccgaauccacagagaacagcaagaugaugcuggaacuugauccucccuuuggcgacucuuacauugugaucgggguuggcgauaagaaaaucacccaccauuggcacagauccggaagcaccauuggcaaggcuuucgaggccacagugcgcggggcuaaacggauggccguccugggagacacggcgugggauuucggcuccguugggggaguguuuaacucucucggcaaggggauccaucagauuuucggcgccgcuuuuaaaagccuguucggaggcauguccugguuuucucaaauccugauugggacccuucucguguggcugggacugaauacaaagaacggcagcaucucccucaccugucuggcccuugggggagucaugaucuuccugagcacagcugugucugccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9032 - RNA, 2290 nt, Artificial Sequence
  KF268950.1 prME-short mRNA Design 3 opt
gggagaaagcuuaccaugaccagcaucggcauuaucgggcugcuccugacaacggccauggcugccgagauuaccagacggggauccgcguacuauauguaccuugaccgcucugaugcuggcaaggccaucagcuucgccacaaaccugggggugaauaaaugccacguccagauuauggaccucggacauaugugugaugcuaccauguccuaugaaugccccaugcuggacgagggcguugaacccgaugacguggauuguuggugcaacacaaccucuacauggguggucuacgggaccugucaccauaagaaaggagaggccagacggagccgcagagcugugacgcuuccgucccacucuacccggaagcugcaaacacgcagccagaccuggcucgaauccagagaguauacaaaacaucugaucaagguugagaauuggaucuuucggaaccccggcuucgcccuggcggccguggcuauugccuggcuccugggcagcucuaccucccagaaggucaucuaccuugugaugauucugcucaucgcuccugccuauagcauucgcugcaucgggguuucuaauagagacuuuguggaaggaauguccggcgggacgugggucgauguggugcuggagcacggaggcugugucacaguuauggcgcaggacaaacccaccguggauauugaacuugugacaaccaccgucagcaacauggccgaggugcggucuuacugcuacgaggcuuccaucagcgacauggccuccgauucucgcuguccuacacaaggggaggcuuaucuggacaagcagagcgacacgcaguacguuugcaaaagaacccucguggaucggggauggggcaauggcugugggcuguucggaaagggcucccuggucacaugcgccaaauuuaccugcagcaagaagaugacagggaaaucuauccagcccgaaaaccucgaauaucgcauuaugcuguccgugcacggaagccaacauucuggcaugaucguuaaugacauugggcacgagaccgaugaaaacagagccaagguggaggucacgccuaauagcccgcgggcugaggcgacacuuggaggcuucggcucccuggggcucgacugugaacccagaaccggacuggauuuuucugaccuuuacuaucugaccaugaacaauaaacauuggcucgugcacaaggagugguuccacgauaucccucugcccuggcaugccggcgcugacacagggaccccucacuggaacaauaaagaagcccuggucgaguuuaaggaugcccaugcuaaacgccagacagugguugugcucggaagccaggaaggcgccguccacacggcgcuggcuggggcccuugaggccgagauggacggcgcuaagggacggcuguucuccggccaucucaagugcagacugaaaauggauaaacuucgccugaagggggugagcuacucucucuguaccgccgcuuuuacauucaccaagguucccgccgaaacacugcacggaaccgugacggucgaggugcaguaugcgggcaccgacgggccgugcaaagugccugcccaaauggcuguugacaugcagacacugacccccgucggacggcucauuacagccaacccugugaucaccgaauccacggagaacagcaagaugaugcuggaacuugauccucccuuuggcgacucuuacaucgugauuggggucggcgauaagaaaaucacacaccauuggcacagauccggaagcaccauuggcaaggcuuucgaggccacagugcgcggggcgaaacggauggccguucugggagacaccgcuugggauuucggcuccgucgggggaguguuuaauucucucggcaagggggugcaucagaucuucggcgccgcuuuuaaaagccuguucggaggcauguccugguuuucucaaauucugaucgggacccuucucguuuggcugggacugaacacaaagaauggcagcaucucccucacgugucuggcccuugggggagugaugauuuuccugagcaccgccgucucugcuugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9033 - RNA, 2290 nt, Artificial Sequence
  KF383121.1 prME-short mRNA Design 3 opt
gggagaaagcuuaccaugaccagcaucggcauuaucgggcugcuccugacaacggccauggcugccgagauuaccagacggggauccgcguacuauauguaccuugaccgcucugaugcuggcaaggccaucagcuucgccacaacccugggggugaacaaaugccacguccagauuauggaccucggacauaugugugaugcuacaauguccuaugaaugccccaugcuggacgagggcguugaacccgaugacguggauuguuggugcaauaccacaucuaccuggguggucuacgggacgugucaccauaagaaaggagaggccagacggagccgcagagcugugacccuuccgucccacucuacacggaagcugcaaacccgcagccagacauggcucgaauccagagaguauaccaaacaucugaucaagguugagaacuggaucuuucggaaucccggcuucgcccugguggcggucgccauugcuuggcuccugggcagcucuacgucccagaaggugaucuaccuuguuaugauucugcucaucgccccugcuuauagcauucgcugcaucggggugucuaacagagacuuugucgaaggaauguccggcgggacauggguggaugugguccuggagcacggaggcuguguuaccgugauggcccaggacaaacccacaguggauauugaacuugucaccaccacagugagcaauauggcggagguucggucuuacugcuacgaggccuccaucagcgacauggcuuccgauucucgcuguccuacgcaaggggaagccuaucuggacaagcagagcgacacccaguacgugugcaaaagaacacucgucgaucggggauggggcaacggcugugggcuguucggaaagggcucccuggugaccugcgcuaaauuuacaugcagcaagaagaugaccgggaaaucuauccagcccgagaaucucgaauaucgcauuaugcuguccguucacggaagccaacauucuggcaugaucgugaacgacauugggcacgagacggaugaaaauagagccaaggucgaggugacaccuaacagcccgcgggccgaggcuacccuuggaggcuucggcucccuggggcucgacugugaacccagaaccggacuggauuuuucugaccuuuacuaucugacaaugaauaacaaacauuggcucguccacaaggagugguuccacgauaucccucugcccuggcaugcgggcgccgacaccgggacaccucacuggaauaacaaagaagcucugguggaguuuaaggaugcccaugccaaacgccagacgguugugguccucggaagccaggaaggcgcugugcacaccgcccuggcgggggcucuugaggccgagauggacggcgccaagggacggcuguucuccggccaucucaagugcagacugaaaauggauaaacuucgccugaaggggguuagcuacucucucuguacagcugccuuuaccuucacaaaggugcccgcugaaacccugcacggaacggucaccguggaggugcaguaugccggcacagacgggccgugcaaaguuccugcgcaaauggccgucgacaugcagacccugacacccgugggacggcucauuaccgcuaauccugugaucacggaauccacagagaacagcaagaugaugcuggaacuugauccucccuuuggcgacucuuacaucgucauuggggugggcgauaagaaaaucacccaccauuggcacagauccggaagcacaauuggcaaggccuucgaggcuaccguucgcggggccaaacggauggcggugcugggagacaccgccugggauuucggcuccgucgggggaguguuuaacucucucggcaaggggauccaucagauuuucggcgcugccuuuaaaagccuguucggaggcauguccugguuuucucaaauccugaucgggacacuucucguuuggcugggacugaauacgaagaacggcagcauuucccucaccugucuggcucuugggggagugaugaucuuccugagcacagccgucucugccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9034 - RNA, 2272 nt, Artificial Sequence
  KF268949.1 prME-short mRNA Design 3 opt
gggagaaagcuuaccaugaccagcaucggcauuaucgggcugcuccugacaacggccauggcugccgagauuaccagacggggauccgcguacuauauguaccuugaccgcucugaugcuggcaaggccaucagcuucgccacaaaccugggggugaauaaaugccacguccagauuauggaccucggacauaugugugaugcuaccauguccuaugaaugccccaugcuggacgagggcguugaacccgaugacguggauuguuggugcaacacaaccucuacauggguggucuacgggaccugucaccauaagaaaggagaggccagacggagccgcagagcugugacgcuuccgucccacucuacccggaagcugcaaacacgcagccagaccuggcucgaauccagagaguauacaaaacaucugaucaagguugagaauuggaucuuucggaaccccggcuucgcccuggcggccguggcuauugccuggcuccugggcagcucuaccucccagaaggucaucuaccuugugaugauucugcucaucgcuccugccuauagcauucgcugcaucgggguuucuaauagagacuuuguggaaggaauguccggcgggacgugggucgauguggugcuggagcacggaggcugugucacaguuauggcgcaggacaaacccaccguggauauugaacuugugacaaccaccgucagcaacauggccgaggugcggucuuacugcuacgaggcuuccaucagcgacauggccuccgauucucgcuguccuacacaaggggaggcuuaucuggacaagcagagcgacacgcaguacguuugcaaaagaacccucguggaucggggauggggcaauggcugugggcuguucggaaagggcucccuggucacaugcgccaaauuuaccugcagcaagaagaugacagggaaaucuauccagcccgaaaaccucgaauaucgcauuaugcuguccgugcacggaagccaacauucuggcaugaucguuaaugacgagaacagagccaagguggaagucaccccuaauagcccgcgggcugaggcgacgcuugggggauucggcucccugggccucgauugugagcccagaacagggcuggacuuuucugaucuuuacuaucugaccaugaacaauaaacacuggcucgugcauaaggaaugguuccacgacauuccucugcccuggcacgccggagcugauaccggcacaccucauuggaacaauaaagaggcccuggucgaauuuaaggacgcccacgcuaaacgccagaccgugguugugcucgggagccaggagggagccguccauacagcgcuggcuggcgcccuugaagccgagauggauggggcuaagggccggcuguucuccggacaccucaagugcagacugaaaauggacaaacuucgccugaagggcgugagcuacucucucuguacggccgcuuuuaccuucacaaagguucccgccgagacccugcaugggacagugaccgucgaagugcaguaugcgggaacggauggcccgugcaaagugccugcccaaauggcuguugacaugcagacccugacacccgucgggcggcucaucaccgccaacccugugauuacagaguccaccgaaaacagcaagaugaugcuggagcuugacccucccuuuggagauucuuacaucgugaucggcgucggggacaagaaaauuacgcaccacuggcauagauccggcagcacaaucggaaaggcuuucgaagccaccgugcgcggcgcgaaacggauggccguucugggggauacagcuugggacuucggauccgugggcggggucuuuaauucucucggaaagggcauucaccagaucuucggggccgcuuuuaaaagccuguucggcggaauguccugguuuucucaaauucugaucggcacccuucucguguggcuggggcugaacaccaagaauggaagcaucucccucacaugucuggcccuuggcgggguuaugauuuuccugagcacggccgugucugcuugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9035 - RNA, 2290 nt, Artificial Sequence
  KU955595.1 prME-short mRNA Design 3 opt
gggagaaagcuuaccaugaccagcaucggcauuguggggcugcuccugacaacggccauggcugccgagaucaccagacggggauccgcguacuauauguaccuugaccgcucugaugcuggcaaggccauuagcuucgccacaacccugggggucaacaaaugccacguucagaucauggaccucggacauaugugugaugcuacaauguccuaugaaugccccaugcuggacgagggcguggaacccgaugacguggauuguuggugcaauaccacaucuaccugggucguguacgggacgugucaccauaagaaaggagaggccagacggagccgcagagcuguuacccuuccgucccacucuacacggaagcugcaaacccgcagccagacauggcucgaauccagagaguauaccaaacaucugauuaagguggagaacuggaucuuucggaaucccggcuucgcccuggucgcgguggccaucgcuuggcuccugggcagcucuacgucccagaagguuauuuaccuugugaugauccugcucauugccccugcuuauagcauccgcugcauuggggucucuaacagagacuuuguggaaggaauguccggcgggacauggguggaugucguucuggagcacggaggcugugugaccgugauggcccaggacaaacccacagucgauaucgaacuugugaccaccacaguuagcaauauggcggaggugcggucuuacugcuacgaggccuccauuagcgacauggcuuccgauucucgcuguccuacgcaaggggaagccuaucuggacaagcagagcgacacccaguacgucugcaaaagaacacucguggaucggggauggggcaacggcugugggcuguucggaaagggcucccugguuaccugcgcuaaauuuacaugcagcaagaagaugaccgggaaaucuauccagcccgagaaucucgaauaucgcaucaugcuguccgugcacggaagccaacauucuggcaugauugucaacgacacggggcacgagacagaugaaaauagagccaagguggaggucaccccuaacagcccgcgggccgaggcuacccuuggaggcuucggcucccuggggcucgacugugaacccagaacaggacuggauuuuucugaccuuuacuaucugaccaugaauaacaaacauuggcucgugcacaaggagugguuccacgauaucccucugcccuggcaugcgggcgccgacacagggacgccucacuggaauaacaaagaagcucugguugaguuuaaggaugcccaugccaaacgccagaccguggucgugcucggaagccaggaaggcgcuguucacacagcccuggcgggggcucuugaggccgagauggacggcgccaagggacggcuguucuccggccaucucaagugcagacugaaaauggauaaacuucgccugaagggggugagcuacucucucuguaccgcugccuuuacauucaccaagguccccgcugaaacgcugcacggaaccgugacaguggagguucaguaugccggcaccgacgggccgugcaaagucccugcgcaaauggccguggacaugcagacacugacccccgugggacggcucauuacggcuaauccugucaucacagaauccaccgagaacagcaagaugaugcuggaacuugauccucccuuuggcgacucuuacauugugaucgggguuggcgauaagaaaaucacacaccauuggcacagauccggaagcaccauuggcaaggccuucgaggcuaccgugcgcggggccaaacggauggcgguccugggagacacagccugggauuucggcuccguugggggaguguuuaacucucucggcaaggggauccaucagauuuucggcgcugccuuuaaaagccuguucggaggcauguccugguuuucucaaauccugauugggacgcuucucguguggcugggacugaauaccaagaacggcagcaucucccucacaugucuggcucuugggggagucaugaucuuccugagcaccgccgugucugccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9036 - RNA, 2290 nt, Artificial Sequence
  KF383116.1 prME-short mRNA Design 3 opt
gggagaaagcuuaccaugaccagcaucggcauuguggggcugcuccugacaacggccauggcugccgagaucaccagacggggauccgcguacuauauguaccuugaccgcucugaugcuggcaaggccauuagcuucgccacaacccugggggucaacaaaugccacguucagaucauggaccucggacauaugugugaugcuacaauguccuaugaaugccccaugcuggacgagggcguggaacccgaugacguggauuguuggugcaauaccacaucuaccugggucguguacgggacgugucaacacaagaaaggagaggccagacggagccgcagagcuguuacccuuccgucccauucuacacggaagcugcagacccgcagccagacauggcucgaauccagagaguauaccaaacaccugauuaagguggagaacuggaucuuucggaaucccggcuucgcccuggucgcgguggccaucgcuuggcuccugggcagcucuacgucccagaagguuauuuaccuugugaugauccugcucauugccccugcuuauagcauccgcugcauuggggucucuaacagagacuuuguggaaggaauguccggcgggacauggguggaugucguucuggagcauggaggcugugugaccgugauggcccaagacaaacccacagucgauaucgaacuugugaccaccacaguuagcaauauggcggaggugcggucuuacugcuacgaggccuccauuagcgacauggcuuccgauucucgcuguccuacgcagggggaagccuaucuggacaagcagagcgacacccaguacgucugcaaaagaacacucguggaucggggauggggcaacggcugugggcuguucggaaagggcucccugguuaccugcgcuaaauuuacaugcagcaagaagaugaccgggaaaucuauccaacccgagaaucucgaauaucgcaucaugcuguccgugcacggaagccagcacucuggcaugauugucaacgacaucgggcaugagacggaugaaaauagagccaagguggaggucacaccuaacagcccgcgggccgaggcuacccuuggaggcuucggcucccuggggcucgacugugaacccagaaccggacuggauuuuucugaccuuuacuaucugacaaugaauaacaaacacuggcucgugcauaaggagugguuccacgauauuccucugcccuggcacgcgggcgccgacaccgggacaccucauuggaauaacaaagaagcucugguugaguuuaaggaugcccacgccaaacgccagacgguggucgugcucggaagccaggaaggcgcuguucauaccgcccuggcgggggcucuugaggccgagauggacggcgccaagggacggcuguucuccggccaccucaagugcagacugaaaauggauaaacuucgccugaagggggugagcuacucucucuguacagcugucugcaccgccgcuaaggugcccgccgaaacacugcauggaaccgugacgguugagguccaauaugcgggcaccgacgggccguguaaagugccugcccagauggcuguggacaugcagacacugacccccgucggacggcucaucacagccaauccugugauuaccgaauccacggagaacagcaagaugaugcuggaacuugauccucccuuuggcgacucuuacaucguuaucggggugggcgauaagaaaauuacacaccacuggcauagauccggaagcaccaucggcaaggcuuucgaggccacaguccgcggggcgaaacggauggccgugcugggagacaccgcuugggauuuuggcuccguugggggaguguucaacucucucggcaaggggauucaccaaaucuucggcgccgcuuuuaaaagccuguucggaggcauguccugguuuucucagauucugaucgggacccuucucgucuggcugggacugaauacaaagaacggcagcaucucccucacgugccuggcccuugggggagugaugauuuuccugagcaccgccguuucugcuugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9037 - RNA, 2272 nt, Artificial Sequence
  KX601166.1 prME-short mRNA Design 3 opt
gggagaaagcuuaccaugaccagcaucggcauuguggggcugcuccugacaacggccauggcugccgagaucaccagacggggauccgcguacuauauguaccuugaccgcucugaugcuggcaaggccauuagcuucgccacaacccugggggucaacaaaugccacguucagaucauggaccucggacauaugugugaugcuacaauguccuaugaaugccccaugcuggacgagggcguggaacccgaugacguggauuguuggugcaauaccacaucuaccugggucguguacgggacgugucaccauaagaaaggagaggccagacggagccgcagagcuguuacccuuccgucccacucuacacggaagcugcaaacccgcagccagacauggcucgaauccagagaguauaccaaacaucugauuaagguggagaacuggaucuuucggaaucccggcuucgcccuggucgcgguggccaucgcuuggcuccugggcagcucuacgucccagaagguuauuuaccuugugaugauccugcucauugccccugcuuauagcauccgcugcauuggggucucuaacagagacuuuguggaaggaauguccggcgggacauggguggaugucguucuggagcacggaggcugugugaccgugauggcccaggacaaacccacagucgauaucgaacuugugaccaccacaguuagcaauauggcggaggugcggucuuacugcuacgaggccuccauuagcgacauggcuuccgauucucgcuguccuacgcaaggggaagccuaucuggacaagcagagcgacacccaguacgucugcaaaagaacacucguggaucggggauggggcaacggcugugggcuguucggaaagggcucccugguuaccugcgcuaaauuuacaugcagcaagaagaugaccgggaaaucuauccagcccgagaaucucgaauaucgcaucaugcuguccgugcacggaagccaacauucuggcaugauugucaacgacgagaauagagccaagguggaagucacgccuaacagcccgcgggccgaggcuacacuugggggauucggcucccugggccucgauugugagcccagaaccgggcuggacuuuucugaucuuuacuaucugaccaugaauaacaaacacuggcucgugcauaaggaaugguuccacgacaucccucugcccuggcacgcgggagccgauacaggcaccccucauuggaauaacaaagaggcucugguugaauuuaaggacgcccacgccaaacgccagacaguggucgugcucgggagccaggagggagcuguucauacggcccuggcgggcgcucuugaagccgagauggauggggccaagggccggcuguucuccggacaccucaagugcagacugaaaauggacaaacuucgccugaagggcgugagcuacucucucuguaccgcugccuuuacauucaccaagguccccgcugagacacugcaugggaccgugacgguggaaguucaguaugccggaaccgauggcccgugcaaagucccugcgcaaauggccguggacaugcagacacugacccccguggggcggcucauuacagcuaauccugucaucaccgaguccacggaaaacagcaagaugaugcuggagcuugacccucccuuuggagauucuuacauugugaucggcguuggggacaagaaaaucacacaccacuggcauagauccggcagcaccauuggaaaggccuucgaagcuacagugcgcggcgccaaacggauggcgguccugggggauaccgccugggacuucggauccgugggcgggguuuuuaacucucucggaaagggcauccaccagauuuucggggcugccuuuaaaagccuguucggcggaauguccugguuuucucaaauccugauuggcacccuucucguguggcuggggcugaauacaaagaacggaagcaucucccucacgugucuggcucuuggcggggucaugaucuuccugagcaccgccgugucugccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9038 - RNA, 2290 nt, Artificial Sequence
  KF383118.1 prME-short mRNA Design 3 opt
gggagaaagcuuaccaugaccagcaucggcauuaucgggcugcuccugacaacggccauggcugccgagauuaccagacggggauccgcguacuauauguaccuugaccgcucugaugcuggcaaggccaucagcuucgccacaacccugggggugaacaaaugccacguccagauuauggaccucggacauaugugugaugcuacaauguccuaugaaugccccaugcuggacgagggcguugaaccugaugacguggauuguuggugcaauaccacaucuaccuggguggucuacgggacgugucaccauaagaaaggagagaccagacggagccgcagauccgugucucuucgguaucacuacacacgcaagcugcaaaccagaagccagacauggcucgaaucccgggaguauaaaaagcaucugaucaugguugagaacuggaucuuucgcaauccgggcuucgccauugugagcgucgcuaucaccuggcugaugggcucucucacgucccagaaggugauuuaccugguuaugaucgugcuuauuguccccgccuacagcaucucuugcauugggguguccaacagagaccugguggaaggaaugagcggcgggacaugggucgauguugugcucgagcacggaggcugugugaccgaaauggcgcaggacaaaccuacagucgauaucgagcuggugaccaugaccguuucuaauauggccgaggugcgguccuauugcuacgaagcuagccuuuccgacauggccucugcuagccgcugucccacacaaggggagccuucccuggauaagcagagcgacacgcagucugucugcaaaagaacccucggagaccggggcuggggcaacggguguggaaucuuuggcaaggggucccuggugacaugcagcaaauuuaccugcuguaagaagaugcccggaaaaucuauucagccugaaaaucuggaguaucgcaucaugcucccgguucacggcagccaacauuccgggaugauugugaacgauaucggacacgaaacagacgagaauagagccaaggucgaggugacccccaacucuccucgggcggaagccacgcugggcggcuuugggagccuuggacuggauugcgagcccagaacaggccucgacuucuccgaucuguacuaucuuaccaugaauaacaaacauuggcugguccacaaggaaugguuucacgacauuccucuccccuggcaugcuggggccgauaccggaacaccgcacuggaauaacaaagaggcucugguggaguucaaggacgcccaugccaaacgccagaccguugugguccugggcagccaggaaggggcugugcacacagcgcucgccggcgcucuggaggccgaaauggauggagccaagggccggcuuuucucugggcaucugaaguguagacucaaaauggacaagcugcgccuuaaaggaguuuccuacagccugugcacggcugccuucaccuuuacaaaggugccugcggagacccuccacggcacagucaccguggaagugcagucugcugggacggauggacccuguaaaguuccugcccaaauggccgucgacaugcagacccugacacccgugggccggcugaucaccgcuaaucccgugaucacagaguccaccgaaaacagcaagaugaugcucgagcuggacccuccguucggggauuccuauauugucaucggcgugggagacaagaaaauuacgcaccauuggcacagaucuggcagcacaaucgggaaggccuuugaggcuaccguucgcggagccaaacggauggcggugcuuggcgauacagccugggacuucggguccgucggaggcguguucaacucucuggggaagggcauucaucagaucuuuggagcugccuucaaaagccucuuuggcgggauguccugguucagccaaauccugauuggaacccugcuuguuuggcucggccugaauaccaagaacgggucuaucucccugacaugccucgcucugggaggcgugaugauuuuucuuagcacggccgucucugcgugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9039 - RNA, 2287 nt, Artificial Sequence
  KX447520.1 prME-short mRNA Design 3 opt
gggagaaagcuuaccaugagcgugggcaucgucgggcugcuccugaccacagccauggcugccgagguuacgagacggggauccgcguacuauauguaccuugaccgcaacgaugcuggcgaagccauuucuuuccccaccacacuggggaugaauaagugcuauauccagauuauggaccucggacacaugugugaugccaccaugagcuacgagugcccuaugcuggacgaaggcguggagccggaugacguggauuguuggugcaacacaaccuccacaugggucguguaugggaccugucaucacaaaaagggagaagcuagacggucucgcagagccguuacgcuucccagccauuccacccggaaacugcaaacacgcucucagaccuggcucgagagcagagaguacacaaagcaccugauccggguggaaaauuggauuuuucgcaacccuggcuucgcucuggccgcggccgcuaucgccuggcuccugggcuccagcaccucucagaaagucaucuaucuugugaugauucugcucaucgcucccgccuacuccauuagaugcaucgggguuagcaaucgggacuuuguggagggaaugucuggcgggacgugggucgauguggugcuggaacauggaggcugugucacaguuauggcgcaggacaagccuaccguggauauugagcuugugacaaccaccgucuccaacauggccgaggugcgcagcuacugcuaugaagccucuaucuccgacauggcuagcgauuccagaugucccacacaaggggaggcuuaccuggacaagcagucugacacgcaguauguuugcaaacggacccucguggaucgcggauggggcaauggcugugggcuguucggaaagggcagccuggucacaugcgccaaauuugccugcuccaagaaaaugaccggaaagagcauucagccugaaaaccucgaguacagaaucaugcugucugugcacgggucccaacacagcggcaugaucguuaaugacacagggcaugaaaccgaugagaaccgggcuaagguggagauuacgcccaauucucccagagcggaagccacacuuggaggcuucggcagccuggggcucgacugugagccucgcaccggacuggauuuuuccgaccuuuauuaccugaccaugaacaauaaacacuggcucguccauaaggaaugguuccacgauaucccccugccuuggcacgcuggcgccgacacagggaccccgcauuggaacaauaaagaggcccugguggaauuuaaggaugcucacgccaaacggcagacagucgugguucucggaucucaggagggcgcggugcauacggcucuggccggggcccuugaggcugaaauggacggcgccaagggaagacugagcuccggccaccucaaaugccgccugaagauggauaagcugcggcugaaaggggucagcuauucucucuguaccgcugccuucacauuuaccaagauuccggcggagacacugcauggaaccgugacgguugaagugcaguacgccggcaccgacgggccuugcaaaguccccgcucaaauggccguggacaugcagacacugaccccugugggaagacucaucacagcuaaccccguuauuaccgaguccacggaaaacagcaagaugaugcuggagcuugaucccccuuucggcgacucuuacaucgucaucggggugggcgagaaaaagauuacacaccacuggcaucgcuccggaagcaccaucggcaaggccuuugaagcgacagugagaggggccaaacggauggcuguccugggagauaccgccugggacuucggcuccguugggggagcucucaauucucugggcaaggggauucaccagaucuucggcgccgccuuuaaaagccuguucggaggcauguccugguuuucucaaauucuuaucgggacccuccugauguggcugggacucaacacaaagaauggcagcaucucccugaugugucuugcucuugggggagugcucauuuuccugagcacggcggugucugccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9040 - RNA, 2290 nt, Artificial Sequence
  KU761561.1 prME-short mRNA Design 3 opt
gggagaaagcuuaccaugaccagcgugggcaucgucgggcugcuccugacaacggccauggcugccgagguuaccagacggggauccgcguacuauauguaccuugaccgcaacgaugcuggcgaagccauuucuuuccccacaacccuggggaugaauaagugcuauauccagauuauggaccucggacacaugugugaugccacaaugagcuacgagugcccuaugcuggacgaaggcguggagccggaugacguggauuguuggugcaacaccacauccaccugggucguguaugggacgugucaucacaaaaagggagaagcuagacggucucgcagagccguuacccuucccagccauuccacacggaaacugcaaacccgcucucagacauggcucgagagcagagaguacaccaagcaccugauccggguggaaaauuggauuuuucgcaacccuggcuucgcucuggccgcggccgcuaucgccuggcuccugggcuccagcacgucucagaaagucaucuaucuugugaugauucugcucaucgcucccgccuacuccauuagaugcaucgggguuagcaaucgggacuuuguggagggaaugucuggcgggacaugggucgauguggugcuggaacauggaggcugugucaccguuauggcgcaggacaagccuacaguggauauugagcuugugaccaccacagucuccaacauggccgaggugcgcagcuacugcuaugaagcuagcaucuccgacauggccagcgauuccagaugucccacgcaaggggaggcuuaccuggacaagcagucugacacccaguauguuugcaaacggacacucguggaucgcggauggggcaauggcugugggcuguucggaaagggcagccuggugaccugcgccaaauuugccugcuccaagaaaaugacagggaagucuauucagccugaaaaccucgaguacagaaucaugcugucugugcacggaucccaacacagcggcaugaucguuaaugacaccgggcaugaaacggaugagaaccgggcuaagguggagauuacacccaauucuccgagagcggaagccacccuuggaggcuucggcagccuggggcucgacugugagccucgcaccggacuggauuuuuccgaccuuuauuaccugacaaugaacaauaaacacuggcucguccauaaggaaugguuccacgauaucccccugccuuggcacgcuggcgccgacaccgggacaccccauuggaacaauaaagaggcccugguggaauuuaaggaugcucacgccaaacggcagacggucgugguucucggaucucaggagggcgcggugcauaccgcucuggccggggcccuugaggcugaaauggacggcgccaagggaagacugagcuccggccaccucaaaugccgccugaagauggauaagcugcggcugaaaggggucagcuauucucucuguacagcugccuucaccuuuacaaagauuccggcggagacccugcauggaacggugaccguugaagugcaguacgccggcacagacgggccuugcaaaguccccgcucaaauggccguggacaugcagacccugacaccugugggaagacucaucaccgcuaaccccguuauuacggaguccacagaaaacagcaagaugaugcuggagcuugaucccccuuucggcgacucuuacaucgucaucggggugggcgagaaaaagauuacccaccacuggcaucgcuccggaagcacaaucggcaaggccuuugaagcgaccgugagaggggcccggcgcauggcuguccugggagauaccgccugggacuucggcuccgucgggggagcucucaauucucugggcaaagggauucaccagaucuucggcgccgccuuuaagagccuguucggaggcauguccugguuuucucaaauucuuaucgggacacuccugauguggcugggacucaacacgaaaaauggcagcaucucccugaugugucuugcucuugggggaguucucauuuuccugagcaccgcggugucugccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9041 - RNA, 2290 nt, Artificial Sequence
  KX806557.2 prME-short mRNA Design 3 opt
gggagaaagcuuaccaugaccagcgugggcaucgucgggcugcuccugacaacggccauggcugccgagguuaccagacggggauccgcguacuauauguaccuugaccgcaacgaugcuggcgaagccauuucuuuccccacaacccuggggaugaauaagugcuauauccagauuauggaccucggacacaugugugaugccacaaugagcuacgagugcccuaugcuggacgaaggcguggagccggaugacguggauuguuggugcaacaccacauccaccugggucguguaugggacgugucaucacaaaaagggagaagcuagacggucucgcagagccguuacccuucccagccauuccacacggaaacugcaaacccgcucucagacauggcucgagagcagagaguacaccaagcaccugauccggguggaaaauuggauguuucgcaacccuggcuucgcucuggccgcggccgcuauugccuggcuccugggcuccagcacgucucagaaagucaucuaucuugugaugauccugcucauugcucccgccuacuccaucagaugcauugggguuagcaaucgggacuuuguggagggaaugucuggcgggacaugggucgauguggugcuggaacauggaggcugugucaccguuauggcgcaggacaagccuacaguggauaucgagcuugugaccaccacagucuccaacauggccgaggugcgcagcuacugcuaugaagcuagcauuuccgacauggccagcgauuccagaugucccacgcaaggggaggcuuaccuggacaagcagucugacacccaguauguuugcaaacggacacucguggaucgcggauggggcaauggcugugggcuguucggaaagggcagccuggugaccugcgccaaauuugccugcuccaagaaaaugacagggaagucuauccagccugaaaaccucgaguacagaauuaugcugucugugcacggaucccaacacagcggcaugaucguuaaugacaccgggcaugaaacggaugagaaccgggcuaagguggagaucacacccaauucuccgagagcggaagccacccuuggaggcuucggcagccuggggcucgacugugagccucgcaccggacuggauuuuuccgaccuuuauuaccugacaaugaacaauaaacacuggcucguccauaaggaaugguuccacgauauuccccugccuuggcacgcuggcgccgacaccgggacaccccauuggaacaauaaagaggcccugguggaauuuaaggaugcucacgccaaacggcagacggucgugguucucggaucucaggagggcgcggugcauaccgcucuggccggggcccuugaggcugaaauggacggcgccaagggaagacugagcuccggccaccucaaaugccgccugaagauggauaagcugcggcugaaaggggucagcuauucucucuguacagcugccuucaccuuuacaaagaucccggcggagacccugcauggaacggugaccguugaagugcaguacgccggcacagacgggccuugcaaaguccccgcucaaauggccguggacaugcagacccugacaccugugggaagacucauuaccgcuaaccccguuaucacggaguccacagaaaacagcaagaugaugcuggagcuugaucccccuuucggcgacucuuacauugucaucggggugggcgagaaaaagaucacccaccacuggcaucgcuccggaagcacaauuggcaaggccuuugaagcgaccgugagaggggccaaacggauggcuguccugggagauaccgccugggacuucggcuccgucgggggagcucucaauucucugggcaaggggauccaccagauuuucggcgccgccuuuaaaagccuguucggaggcauguccugguuuucucaaauccuuauugggacacuccugauguggcugggacucaacacgaagaauggcagcaucucccugaugugucuugcucuugggggaguucucaucuuccugagcaccgcggugucugccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9042 - RNA, 2290 nt, Artificial Sequence
  LC191864.1 prME-short mRNA Design 3 opt
gggagaaagcuuaccaugaccagcgugggcaucgucgggcugcuccugacaacggccauggcugccgagguuaccagacggggauccgcguacuauauguaccuugaccgcaacgaugcuggcgaagccauuucuuuccccacaacccuggggaugaauaagugcuauauccagauuauggaccucggacacaugugugaugccacaaugagcuacgagugcccuaugcuggacgaaggcguggagccggaugacguggauuguuggugcaacaugaccuccacaugggucguguaugggaccugucaucacaaaaagggagaagcuagacggucucgcagagccguuacgcuucccagccauuccacccggaaacugcaaacacgcucucagaccuggcucgagagcagagaguacacaaagcaccugauccggguggaaaauuggauuuuucgcaacccuggcuucgcucuggccgcggccgcuaucgccuggcuccugggcuccagcaccucucagaaagucaucuaucuugugaugauucugcucaucgcucccgccuacuccauuagaugcaucgggguuagcaaucgggacuuuguggagggaaugucuggcgggacgugggucgauguggugcuggaacauggaggcugugucacaguuauggcgcaggacaagccuaccguggauauugagcuugugacaaccaccgucuccaacauggccgaggugcgcagcuacugcuaugaagccucuaucuccgacauggcuagcgauuccagaugucccacacaaggggaggcuuaccuggacaagcagucugacacgcaguauguuugcaaacggacccucguggaucgcggauggggcaauggcugugggcuguucggaaagggcagccuggucacaugcgccaaauuugccugcuccaagaaaaugaccggaaagagcauucagccugaaaaccucgaguacagaaucaugcugucugugcacgggucccaacacagcggcaugaucguuaaugacacagggcaugaaaccgaugagaaccgggcuaagguggagauuacgcccaauucucccagagcggaagccacacuuggaggcuucggcagccuggggcucgacugugagccucgcaccggacuggauuuuuccgaccuuuauuaccugaccaugaacaauaaacacuggcucguccauaaggaaugguuccacgauaucccccugccuuggcacgcuggcgccgacacagggaccccgcauuggaacaauaaagaggcccugguggaauuuaaggaugcucacgccaaacggcagacagucgugguucucggaucucaggagggcgcggugcauacggcucuggccggggcccuugaggcugaaauggacggcgccaagggaagacugagcuccggccaccucaaaugccgccugaagauggauaagcugcggcugaaaggggucagcuauucucucuguaccgcugccuucacauuuaccaagauuccggcggagacacugcauggaaccgugacgguugaagugcaguacgccggcaccgacgggccuugcaaaguccccgcucaaauggccguggacaugcagacacugaccccugugggaagacucaucacagcuaaccccguuauuaccgaguccacggaaaacagcaagaugaugcuggagcuugaucccccuuucggcgacucuuacaucgucaucggggugggcgagaaaaagauuacacaccacuggcaucgcuccggaagcaccaucggcaaggccuuugaagcgacagugagaggggccaaacggauggcuguccugggagauaccgccugggacuucggcuccguugggggagcucucaauucucugggcaaggggauucaccagaucuucggcgccgccuuuaaaagccuguucggaggcauguccugguuuucucaaauucuuaucgggacccuccugauguggcugggacucaacacaaagaauggcagcaucucccugaugugucuugcucuugggggagugcucauuuuccugagcacggcggugucugccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9043 - RNA, 2290 nt, Artificial Sequence
  KU744693.1 prME-short mRNA Design 3 opt
gggagaaagcuuaccaugaccagcgugggcaucgucgggcugcuccugacaacggccauggcugccgagguuaccagacggggauccgcguacuauauguaccuugaccgcaacgaugcuggcgaagccauuucuuuccccacaacccuggggaugaauaagugcuauauccagauuauggaccucggacacaugugugaugccacaaugagcuacgagugcccuaugcuggacgaaggcguggagccggaugacguggauuguuggugcaacaccacauccaccugggucguguaugggacgugucaucacaaaaagggagaagcuagacggucucgcagagccguuacccuucccagccauuccacacggaaacugcaaacccgcucucagacauggcucgagagcagagaguacaccaagcaccugauccggguggaaaauuggauuuuucgcaacccuggcuucgcucuggccgcggccgcuaucgccuggcuccugggcuccagcacgucucagaaagucaucuaucuugugaugauucugcucaucgcucccgccuacuccauuagaugcaucgggguuagcaaucgggacuuuguggagggaaugucuggcgggacaugggucgauguggugcuggaacauggaggcugugucaccgcgauggcccaggacaagccuacaguugauauugagcuugugaccaccacaguguccaacauggcugagguccgcagcuacugcuaugaagccucuaucuccgacauggcuagcgauuccagaugucccacgcaaggggaggccuaccuggacaagcagucugacacccaguaugugugcaaacggacacucguugaucgcggauggggcaauggcugugggcuguucggaaagggcagccuggugaccugcgccaaauuugcuugcuccaagaaaaugacagggaagucuauucagccugaaaaccucgaguacagaaucaugcugucuguccacggaucccaacacagcggcaugcuugugaaugacaccgggcaugaaacggaugagaaccgggcgaagguugagaucacaccgaauagccccagagccgaagcuacccugggaggcuucggcagccucgggcuggacugugagccucgcaccggacuugauuuuuccgaccuguauuaccucacaaugaacaauaaacacuggcuggcccauaaggaaugguuccacgauauuccccugccuuggcacgccggcgcugccaccgggacaccccauuggaacaauaaagaggcgcucguggaauuuaaggacgcucacgccaaacggcagacggucgugguccugggaucucaggagggcgccgugcauaccgcucuugccggggcucuggaggccgaaauggauggcgcgaagggaagacucagcuccggccaccugaaaugccgccuuaagauggacaagcugcggcucaaagggguuagcuauucucuguguacagccgcuuucaccuuuacaaagaucccggccgagaccguggauggaacggucaccguggaaggccaguacgggggaacagacggcccuugcaaaguucccgcucaaauggccguggacaugcagacccugacaccugucgggagacucauuaccgcgaaccccgugaucacggaguccacagaaaacagcaagaugaugcuggagcuugaucccccuuucggcgacucuuacauugugaucggaguuggcgagaaaaagaucacccaucacuggcaccgcuccgggagcacaauuggaaaggccuuugaagcuaccguccggggcgccaaaagaauggcugugcugggggauaccgccugggacuucggauccgugggcggggcccucaauucucugggcaagggaauccaucagauuaucggcgcugcguucaaaagccuguuugggggaauguccugguucucucaaauucuuaucggcacacuccugauguggcuggggcucaacacgaagaauggaagcaucucccugaugugucuugcccugggcgggguccucauuuuucugagcaccgcugugucuggcugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9044 - RNA, 2281 nt, Artificial Sequence
  KU963574.2 prME-short mRNA Design 3 opt
gggagaaagcuuaccaugggcgccgacgcuagcaucgggauugugucccugcuccugaccacagucauggccgcggagaucacgagacggggaucugcuuacuauauguaccuugaucgcagcgacgccggcaaggccauuuccuucguuaccacacugggggugaacaaaugccacgugcagaucauggaucucggacauaugugugacgcuaccaugucuuaugaaugccccaugcuggaugagggcgucgaacccgacgauguggacuguuggugcaauacaaccagcacauggguuguguacgggaccugucaccauaagaaaggagaggccagacggucccgcagagcugucacgcuuccgucucacagcacccggaagcugcaaacacgcucccagaccuggcucgaaagcagagaguauacaaaacaucugauuaagguggagaacuggaucuuucggaaucccggcuucgcccugguugcgguggccaucgcuuggcuccugggaucuuccaccagccagaaggucauuuaccuugugaugauccugcucauugccccugcuuauucuauccgcugcauugggguguccaacagagauuuugucgaaggaaugagcggcgggacguggguugacguggugcuggagcacggaggcugugucacagugauggcccaggauaaacccaccguugacaucgaacuugugacaaccaccgucucuaauauggcggaggugcgguccuacugcuacgaggccagcauuuccgauauggcuucugacagccgcuguccuacacaaggggaagccuaucuggacaagcaguccgauacgcaguacguuugcaaaagaacccucguggaccggggauggggcaacggcugugggcuguucggaaagggcagccuggucacaugcgcuaaauuuaccugcucuaagaagaugacagggaaauccauccagcccgagaaucucgaauaucgcaucaugcugagcgugcacggaucucaacauagcggcaugauugucaacgaugagaauagagccaagguggaaguuaccccuaacuccccgcgggccgaggcuacgcuugggggauucggcucucugggccucgacugugagcccagaacagggcuggauuuuagcgaccuuuacuaucugaccaugaauaacaaacacuggcucgugcauaaggaaugguuccacgauaucccucugcccuggcacuccggagcggacaccgagacaccucauuggaauaacaaagaagcccuggucgaguuuaaggaugcucacgccaaacgccagaccgugguugugcucggcagccaggaaggggccguccauacagcucuggccggagcgcuugaggcugagauggacggcgccaaggggcggcugucuuccggccaccucaagugcagacugaaaauggauaaacuucgccugaagggagugagcuacucucucuguacggccgcuuucaccuuuacaaaggugcccgccgaaacccugcauggcacaguuaccgucgaggugcaguaugcugggcgggacggaccgugcaaagugccugcccaaauggcggucgacaugcagacgcugacccccgugggcagacucauuacagccaauccuguuaucaccgaauccacagagaacagcaagaugaugcuggaacuugauccucccuucggggacuccuacauugugaucggagucggcgauaagaaaaucacccaccacuggcaucgcucugggagcauuaucggcaaggcuuuugaggccacggugcggggagcuaaaagaauggccguucugggcgacacagcgugggauuucggguccgugggaggcgucuucaacucucucgggaagggcauucaccagaucuuuggcgccgcuuucaaaagccuguuugggggcauguccugguucagccaaauucugaucggaacccuucucguguggcugggccugaauacaaagaacgggucuaucucccucaccugucuggcccuuggaggcguuaugauuuuucugagcaccgcugugucugccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9045 - RNA, 2299 nt, Artificial Sequence
  KF383120.1 prME-short mRNA Design 3 opt
gggagaaagcuuaccaugggcgccgacaccagcaucgggauuaucggacugcuccugacaacggcuauggccgcggagauuaccagacggggcuccgcuuacuauauguaccuugaucgcucugacgccgggaaggccaucagcuucgcuacaaccaugggagugaacaaaugccacguccagauuauggaucugggccauaugugugacgccacaauguccuaugaaugccccaugcucgaugaggggguugaaccugacgauguggacuguuggugcaauaccacaucuaccuggguggucuacggaacgugucaccauaagaaaggcgaggcuagaccgagccggcgcgccgugacccugcccucccacucuacaagaaaacuucaaacccggagccagacauggcuggaaucccgcgaguauaccaagcaucucaucaagguugagaacuggauccugagaaauccuggcuuuacgguggcggcccuggcuauggccuggcuccuggggaacagcacaucucagcgggucauuuaccuugugaugauccugcucauugcucccgccuauuccauccgcugcauuggaguuagcaauagagauuucguggaaggcaugucugggggaaccugggucgacguggugcuggagcacggcgggugugucacaguuauggcgcaggauaagccuaccguggacaucgaacuugugaccacaacggucuccaacauggccgaggugcggagcuacugcuacgaggcuucuauuuccgauauggccagcgacucccgcugucccacccaaggagaggcuuaucuggacaaacagucugauacacaguacguuugcaagagaacccucguggaccggggcuggggcaauggguguggacuguuuggcaaagggagccuggucacaugcgccaaguuuaccugcuccaaaaagaugacgggaaagagcauccagccugaaaaccucgaauaucgcaucaugcugucugugcacggcucccaacauagcgggaugauuguuaaugauaucggacacgagacagacgaaaacagagccaaaguggaggucacccccaauucuccccgggcugaggcgacccuuggcggcuucgggagccugggacucgauugugaaccuagaacaggccuggacuucuccgaucuuuacuaucugaccaugaacaauaagcauuggcucgugcacaaagagugguuucacgacauuccccugccuuggcaugccggggcugauacaggaacgccccacuggaacaauaaggaagcccuggucgaguucaaagacgcccaugcuaagcgccagaccgugguugugcucggcucucaggaaggggccguccacacagcgcuggcuggcgcccuugaggccgagauggauggagcuaaaggccggcuguuuagcgggcaucucaagugcagaaucaagauggacaaacugcgccuuaagggaguguccuacagccuguguaccgccgcuuucacauuuucuaaaguuccggccgaaacccuccacggcacggugaccgucgaggugcaguaugcggggcgggacggaccuugcaaggugcccgcccaaauggcuguugauaugcagacacugaccccugucggcagacugauuacagccaaccccaucaucaccgaauccacggagaacagccgcaugaugcucgaacuggacccgccuuucggggauucuuacauugugaucggcgugggagacaaaaagauuacacaccauuggcaccgguccggcagcaccaucgggaaggcuuuugaggccacagucagaggagcgaaacgcauggccgugcuuggcgauaccgcuugggacuucggguccguuggaggcguguucaauucucuggggaagggcguccaucagguguuuggagccgcuuucaaaagccucuuuggcgggauguccugguucucucaaauucugaucggaacccugcuuguuuggcucggccugaacacaaagaaugggagcaucucccuggccugucucgcccugggaggcgcuaugauuuuucuuagcacggcggugucugccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9046 - RNA, 1582 nt, Artificial Sequence; identical to SEQ ID NO: 8821
  KU321639.1 solE mRNA Design 3 opt

SEQ ID NO: 9047 - RNA, 1582 nt, Artificial Sequence; identical to SEQ ID NO: 8822
  KU312312.1 solE mRNA Design 3 opt

SEQ ID NO: 9048 - RNA, 1570 nt, Artificial Sequence; identical to SEQ ID NO: 8823
  AY632535.2 solE mRNA Design 3 opt

SEQ ID NO: 9049 - RNA, 1582 nt, Artificial Sequence; identical to SEQ ID NO: 8822
  KU527068.1 solE mRNA Design 3 opt

SEQ ID NO: 9050 - RNA, 1582 nt, Artificial Sequence
  KX421193.1 solE mRNA Design 3 opt
gggagaaagcuuaccaugagccagaaggugaucuaccuggucaugauucuccugaucgcccccgcuuauuccauuagaugcaucggcguuucuaaccgggacuucguggaggggaugagcggaggcaccuggguggaugucgugcuugaacacgggggauguguuacagugauggcccaagacaaaccuacggucgauauugagcuggugaccacaaccguuuccaauauggcggaagugcgcucuuacugcuaugaggcuagcaucuccgacauggccucugauagcagauguccgacacagggcgaagccuaccucgacaagcaguccgauacccaguaugucugcaaacggacacugguggaccgcggguggggaaacggcuguggccuuuuugggaagggaagccuggugaccugcgcuaaauucacguguucuaagaagaugaccggcaaauccauccaacccgagaaucucgaguacagaauuaugcugagcguccaugggucucagcacuccggaaugaucguuaacgauacaggcuaugaaaccgacgagaaucgggccaagguggaagugacaccuaacagcccccgcgcugaggccacccucgggggauuuggcucucugggccuggauugcgagccuagaacggggcuugacuucuccgaucuguacuaccucacaaugaauaacaaacauuggcugguccacaaggaaugguuucaugacauuccccuuccuuggcacgcgggagccgacaccggcacaccgcacuggaauaacaaagaggcucugguggaguucaaggaugcccaugcuaagcggcagaccguugugguccucgggagccaggaaggagccgugcacaccgcgcuggccggcgcucuggaagccgagauggacggggcuaaaggaaagcucuuuuccggccaucugaaaugucgccuuaagauggauaaacugagacucaagggcguuucuuauagccugugcacagccgccuucacguuuaccaaagugcccgcugagacacuucacgggaccgucacaguggaaguccaauacgcgggaaccgacggcccuuguaagauccccgugcagauggccguugauaugcagacgcugacaccuguggggcggcucauuaccgcuaaucccgucaucaccgaguccacagaaaacagcaagaugaugcuggagcuggacccgccuuucggagauucuuauauugugaucggcguuggggacaaaaagaucacccaccauuggcaccgcuccggcagcacaauuggaaaagccuuugaagccacggugagaggcgcuaagcggauggccguccucggggauaccgcgugggacuucggaucuugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9051 - RNA, 1582 nt, Artificial Sequence
  LC002520.1 solE mRNA Design 3 opt
gggagaaagcuuaccaugagccagaaggugaucuaccuggucaugauucuccugaucgcccccgcuuauuccauuagaugcaucggcguuucuaaccgggacuucguggaggggaugagcggaggcaccuggguggaugucgugcuugaacacgggggauguguuacagugauggcccaagacaaaccuacggucgauauugagcuggugaccacaaccguuuccaauauggcggaagugcgcucuuacugcuaugaggcuagcaucuccgacauggccucugauagcagauguccgacacagggcgaagccuaccucgacaagcaguccgauacccaguaugucugcaaacggacacugguggaccgcggguggggaaacggcuguggccuuuuugggaagggaagccuggugaccugcgcuaaauucacguguucuaagaagaugaccggcaaauccauccaacccgagaaucucgaguacagaauuaugcugagcguccaugggucucagcacuccggaaugacaguuaacgauaucggcuaugaaaccgacgagaaucgggccaagguggaagugacaccuaacagcccccgcgcugaggccacccucgggggauuuggcucucugggccuggauugcgagccuagaacggggcuugacuucuccgaucuguacuaccucacaaugaauaacaaacauuggcugguccacaaggaaugguuucaugacauuccccuuccuuggcacgcgggagccgacaccggcacaccgcacuggaauaacaaagaggcucugguggaguucaaggaugcccaugcuaagcggcagaccguugugguccucgggagccaggaaggagccgugcacaccgcgcuggccggcgcucuggaagccgagauggacggggcuaaaggaaagcucuuuuccggccaucugaaaugucgccuuaagauggauaaacugagacucaagggcguuucuuauagccugugcacagccgccuucacguuuaccaaagugcccgcugagacacuucacgggaccgucacaguggaaguccaauacgcgggaaccgacggcccuuguaagauccccgugcagauggccguugauaugcagacgcugacaccuguggggcggcucauuaccgcuaaucccgucaucaccgaguccacagaaaacagcaagaugaugcuggagcuggacccgccuuucggagauucuuauauugugaucggcguuggggacaaaaagaucacccaccauuggcaccgcuccggcagcacaauuggaaaagccuuugaagccacggugagaggcgcuaagcggauggccguccucggggauaccgcgugggacuucggaucuugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9052 - RNA, 1564 nt, Artificial Sequence
  DQ859059.1 solE mRNA Design 3 opt
gggagaaagcuuaccaugagccagaaggugaucuaccuggucaugauucuccugaucgcccccgcuuauuccauuagaugcaucggcguuucuaaccgggacuucguggaggggaugagcggaggcaccuggguggaugucgugcuugaacacgggggauguguuacagugauggcccaagacaaaccuacggucgauauugagcuggugaccacaaccguuuccaauauggcggaagugcgcucuuacugcuaugaggcuagcaucuccgacauggccucugauagcagauguccgacacagggcgaagccuaccucgacaagcaguccgauacccaguaugucugcaaacggacacugguggaccgcggguggggaaacggcuguggccuuuuugggaagggaagccuggugaccugcgcuaaauucacguguucuaagaagaugaccggcaaauccauccaacccgagaaucucgaguacagaauuaugcugagcguccaugggucucagcacuccggaaugaucguuaacgaugaaaaucgggccaagguggaggugacaccuaacagcccccgcgcugaagccacccugggcggguuuggaucucucggccuggacugcgagccuagaacaggccuugauuucuccgaccuguauuaccucaccaugaauaacaaacauuggcugguccacaaggagugguuucaugauauuccccuuccuuggcacgcgggggccgacacgggaacaccgcacuggaauaacaaagaagcucugguggaguucaaggacgcccaugcuaagcggcagaccguugugguccucggcagccaggaaggggccgugcacacagcgcuggccggagcucuggaggccgaaauggauggcgcuaaagggcgccucuuuuccggacaucugaaguguagacuuaaaauggacaagcugcggcucaaaggcguuucuuacagccugugcaccgccgccuucaccuuuacaaaggugcccgcugagacgcuucacggcaccgucacaguggagguccaauaugcggggaccgauggaccuuguaaagugcccgcccagauggcuguugacaugcagacacugaccccugugggccgccucaucacggccaaucccgucauuacagaauccaccgagaacagcaagaugaugcuggaacuggauccgccuuucggggacucuuacaucgugauuggaguuggcgauaagaaaaucacccaccauuggcacagauccgggagcacaaucggcaaggccuuugaggcuaccgugcggggagccaaacgcauggcgguccucggcgacacagcuugggauuucgggucuugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9053 - RNA, 1570 nt, Artificial Sequence
  KU963573.2 solE mRNA Design 3 opt
gggagaaagcuuaccaugagccagaaggugaucuaccuggucaugauucuccugaucgcccccgcuuauuccauuagaugcaucggcguuucuaaccgggacuucguggaggggaugagcggaggcaccuggguggaugucgugcuugaacacgggggauguguuacagugauggcccaagacaaaccuacggucgauauugagcuggugaccacaaccguuuccaauauggcggaagugcgcucuuacugcuaugaggcuagcaucuccgacauggccucugauagcagauguccgacacagggcgaagccuaccucgacaagcaguccgauacccaguaugucugcaaacggacacugguggaccgcggguggggaaacggcuguggccuuuuugggaagggaagccuggugaccugcgcuaaauucacguguucuaagaagaugaccggcaaauccauccaacccgagaaucucgaguacagaauuaugcugagcguccaugggucucagcacuccggaaugaucggcuaugaaacagaugagaaccgggccaagguugaagugaccccuaauagcccccgcgcugaggccacacucgggggauuuggcucucugggccuggacugcgagccuagaaccgggcuugauuucuccgaccuguacuaccucacgaugaacaauaaacauuggcuggugcacaaggaaugguuucaugauauuccccuuccuuggcacgcgggagccgacacaggcaccccgcacuggaacaauaaagaggcucuggucgaguucaaggacgcccaugcuaagcggcagacagugguugugcucgggagccaggaaggagccguccacaccgcgcuggccggcgcucuggaagccgagauggauggggcuaaaggaaagcucuuuuccggccaucugaaaugucgccuuaagauggacaaacugagacucaagggcgugucuuauagccugugcaccgccgccuucacauuuacgaaaguucccgcugagacccuucacgggacagugaccgucgaagugcaauacgcgggaacagauggcccuuguaagauccccguccagauggccguggacaugcagacccugacgccuguugggcggcucauuacagcuaaccccgugaucaccgaguccaccgaaaauagcaagaugaugcuggagcuggauccgccuuucggagacucuuauauugucaucggcgugggggauaaaaagaucacacaccauuggcaccgcuccggcagcaccauuggaaaagccuuugaagccacaguuagaggcgcuaagcggauggccgugcucggggacacggcgugggauuucggaucuugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9054 - RNA, 1582 nt, Artificial Sequence
  KY075939.1 solE mRNA Design 3 opt
gggagaaagcuuaccaugagccagaaggugaucuaccuggucaugauucuccugaucgcccccgcuuauucccuuagaugcauuggcguuucuaaccgggacuucguggaggggaugagcggaggcaccuggguggaugucgugcuggaacacgggggauguguuacagugauggcccaagacaaaccuacggucgauaucgagcucgugaccacaaccguuuccaauauggcggaagugcgcucuuacugcuaugaggcuagcauuuccgacauggccucugauagcagauguccgacacagggcgaagccuaccuggacaagcaguccgauacccaguaugucugcaaacggacacuuguggaccgcggguggggaaacggcuguggccuguuugggaagggaagccucgugaccugcgcuaaauucgccuguucuaagaagaugacgggcaaauccauccaacccgagaaucuggaguacagaaucaugcugagcguccaugggucucagcacuccggaaugauuguuaacgauaccggccaugaaacagacgagaaucgggcuaagguggaaaucaccccuaacagcccccgcgccgaggcgacacucgggggauuuggcucucugggccuugauugcgagccuagaaccgggcuggacuucuccgaucucuauuaccugacgaugaauaacaaacacuggcuugugcauaaggaaugguuucacgacauuccccugccuuggcacgccggagcugacacaggcaccccgcauuggaauaacaaagaggcccucgucgaguucaaggaugcucacgccaagcggcagacagugguugugcuggggagccaggaaggagcgguccauaccgcccuggcuggcgcccucgaagcugagauggacggggccaaaggacgccuguccucuggccaccuuaaguguagacugaaaauggauaagcuccggcugaaaggcgugagcuacucccuuugcaccgccgcuuuuacauucacgaagauccccgcggagacccugcacgggacaguuaccguggaaguccaauaugccggaacagacggcccuuguaaagugcccgcucagauggccgucgauaugcagacccucacgccuguggggcgccugauuacagccaaucccguuaucaccgagagcaccgaaaacucuaagaugaugcuggagcucgacccgccuuuuggagauuccuacauugugaucggcgucggggaaaagaaaaucacacaucacuggcauagaagcggcucuaccauuggaaaggcuuucgaggccacagugcggggcgcgaaacgcauggcuguucugggggacacggccugggauuuuggaagcugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9055 - RNA, 1582 nt, Artificial Sequence
  KX447516.1 solE mRNA Design 3 opt
gggagaaagcuuaccaugagcaagaaagugaucuaccuggucaugauucuccugaucgcccccgcuuauuccauuagaugcaucggcguuucuaaccgggacuucguggaggggaugagcggaggcaccuggguggaugucgugcuugaacacgggggauguguuacagugauggcccaggacaagccuacggucgauauugagcuggugaccacaaccguuuccaauauggcggaagugcgcucuuacugcuaugaggcuagcaucuccgacauggccucugauagcagauguccgacacaaggcgaagccuaccucgacaaacaguccgauacccaguaugucugcaagcggacacugguggaccgcggguggggaaacggcuguggccuuuuugggaaaggaagccuggugaccugcgcuaaguucgccuguucuaagaaaaugacgggcaaguccauccagcccgagaaucucgaguacagaauuaugcugagcguccaugggucucaacacuccggaaugaucguuaacgauaccggccaugaaacagacgagaaucgggcuaaaguggaaauuaccccuaacagcccccgcgccgaggcgacacucgggggauuuggcucucugggccuggauugcgagccuagaaccgggcuugacuucuccgaucuguauuaccucacgaugaauaacaagcacuggcuggugcauaaagaaugguuucacgacaucccccuuccuuggcacgccggagcugacacaggcaccccgcauuggaauaacaaggaggcccuggucgaguucaaggaugcucacgccaaacggcagacagugguugugcucgggagccaggaaggagcgguccauaccgcccuggcuggcgcccuggaagcugagauggacggggccaagggacgccucuccucuggccaccugaaauguagacuuaagauggauaaacugcggcucaagggcgugagcuacucccugugcaccgccgcuuuuacauucacgaaaauucccgcggagacccuucacgggacaguuaccguggaaguccaguaugccggaacagacggcccuuguaaggugcccgcucaaauggccgucgauaugcagacccugacgccuguggggcgccucaucacagccaaucccguuauuaccgagagcaccgaaaacucuaagaugaugcuggagcuggacccgccuuuuggagauuccuacaucgugaucggcgucggggagaaaaagauuacacaucacuggcauagaagcggcucuaccaucggaaaggcuuucgaagccacagugcggggcgcgaaacgcauggcuguucucggggacacggccugggauuuuggaagcugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9056 - RNA, 1582 nt, Artificial Sequence
  KX447515.1 solE mRNA Design 3 opt
gggagaaagcuuaccaugagccagaaggugaucuaccuggucaugauucuccugaucgcccccgcuuauuccauuagaugcaucggcguuucuaaccgggacuucguggaggggaugagcggaggcaccuggguggaugucgugcuugaacacgggggauguguuacagugauggcccaagacaaaccuacggucgauauugagcuggugaccacaaccguuuccaauauggcggaagugcgcucuuacugcuaugaggcuagcaucuccgacauggccucugauagcagauguccgacacagggcgaagccuaccucgacaagcaguccgauacccaguaugucugcaaacggacacugguggaccgcggguggggaaacggcuguggccuuuuugggaagggaagccuggugaccugcgcuaaauucgccuguucuaagaagaugacgggcaaauccauccaacccgagaaucucgaguacagaauuaugcugagcguccaugggucucagcacuccggaaugaucguuaacgauaccggccaugaaacagacgagaaucgggcuaagguggaaauuaccccuaacagcccccgcgccgaggcgacacucgggggauuuggcucucugggccuggauugcgagccuagaaccgggcuugacuucuccgaucuguauuaccucacgaugaauaacaaacacuggcuggugcauaaggaaugguuucacgacaucccccuuccuuggcacgccggagcugacacaggcaccccgcauuggaauaacaaagaggcccuggucgaguucaaggaugcucacgccaagcggcagacagugguugugcucgggagccaggaaggagcgguccauaccgcccuggcuggcgcccuggaagcugagauggacggggccaaaggacgccucuccucuggccaccugaaguguagacuuaaaauggauaagcugcggcucaaaggcgugagcuacucccugugcaccgccgcuuuuacauucacgaagauucccgcggagacccuucacgggacaguuaccguggaaguccaauaugccggaacagacggcccuuguaaagugcccgcucagauggccgucgauaugcagacccugacgccuguggggcgccucaucacagccaaucccguuauuaccgagagcaccgaaaacucuaagaugaugcuggagcuggacccgccuuuuggagauuccuacaucgugaucggcgucggggaaaagaaaauuacacaucacugguauagaagcggcucuaccaucggaaaggcuuucgaggccacagugcggggcgcgaaacgcauggcuguucucggggacacggccugggauuuuggaagcugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9057 - RNA, 1582 nt, Artificial Sequence
  KU758874.1 solE mRNA Design 3 opt
gggagaaagcuuaccaugagccagaaggugaucuaccuggucaugauucuccugaucgcccccgcuuauuccauuagaugcaucggcguuucuaaccgggacuucguggaggggaugagcggaggcaccuggguggaugucgugcuugaacacgggggauguguuacagugauggcccaagacaaaccuacggucgauauugagcuggugaccacaaccguuuccaauauggcggaagugcgcucuuacugcuaugaggcuagcaucuccgacauggccucugauagcagauguccgacacagggcgaagccuaccucgacaagcaguccgauacccaguaugucugcaaacggacacugguggaccgcggguggggaaacggcuguggccuuuuugggaagggaagccuggugaccugcgcuaaauucgccuguucuaagaagaugacgggcaaauccauccaacccgagaaucucgaguacagaauuaugcugagcguccaugggucucagcacuccggaaugaucguuaacgauaccggccaugaaacagacgagaaucgggcuaagguggaaauuaccccuaacagcccccgcgccgaggcgacacucgggggauuuggcucucugggccuggauugcgagccuagaaccgggcuugacuucuccgaucuguauuaccucacgaugaauaacaaacacuggcuggugcauaaggaaugguuucacgacaucccccuuccuuggcacgccggagcugacacaggcaccccgcauuggaauaacaaagaggcccuggucgaguucaaggaugcucacgccaagcggcagacagugguugugcucgggagccaggaaggagcgguccauaccgcccuggcuggcgcccuggaagcugagauggacggggccaaaggaaagcucuccucuggccaccugaaaugucgccuuaagauggauaaacugagacucaagggcgugagcuacucccugugcaccgccgcuuuuacauucacgaaaauucccgcggagacccuucacgggacaguuaccguggaaguccaauaugccggaacagacggcccuuguaaggugcccgcucagauggccgucgauaugcagacccugacgccuguggggcggcucaucacagccaaucccguuauuaccgagagcaccgaaaacucuaagaugaugcuggagcuggacccgccuuuuggagauuccuacaucgugaucggcgucggggagaaaaagauuacacaucacuggcaucgcagcggcucuaccaucggaaaggcuuucgaagccacagugagaggcgcgaaacggauggcuguucucggggacacggccugggauuuuggaagcugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9058 - RNA, 1582 nt, Artificial Sequence
  KU729218.1 solE mRNA Design 3 opt
gggagaaagcuuaccaugagccagaaggugaucuaccuggucaugauucuccugaucgcccccgcuuauuccauuagaugcaucggcguuucuaaccgggacuucguggaggggaugagcggaggcaccuggguggaugucgugcuugaacacgggggauguguuacagugauggcccaagacaaaccuacggucgauauugagcuggugaccacaaccguuuccaauauggcggaagugcgcucuuacugcuaugaggcuagcaucuccgacauggccucugauagcagauguccgacacagggcgaagccuaccucgacaagcaguccgauacccaguaugucugcaaacggacacugguggaccgcggguggggaaacggcuguggccuuuuugggaagggaagccuggugaccugcgcuaaauucgccuguucuaagaagaugacgggcaaauccauccaacccgagaaucucgaguacagaauuaugcugagcguccaugggucucagcacuccggaaugaucguuaacgauaccggccaugaaacagacgagaaucgggcuaagguggaaauuaccccuaacagcccccgcgccgaggcgacacucgggggauuuggcucucugggccuggauugcgagccuagaaccgggcuugacuucuccgaucuguauuaccucacgaugaauaacaaacacuggcuggugcauaaggaaugguuucacgacaucccccuuccuuggcacgccggagcugacacaggcaccccgcauuggaauaacaaagaggcccuggucgaguucaaggaugcucacgccaagcggcagacagugguugugcucgggagccaggaaggagcgguccauaccgcccuggcuggcgcccuggaagcugagauggacggggccaaaggacgccucuccucuggccaccugaaguguagacuuaaaauggauaagcugcggcucaaaggcgugagcuacucccugugcaccgccgcuuuuacauucacgaagauucccgcggagacccuucacgggacaguuaccguggaaguccaauaugccggaacagacggcccuuguaaagugcccgcucagauggccgucgauacccagacgcugacaccuguggggcgccucaucaccgccaaucccguuauuaccgagagcacagaaaacucuaagaugaugcuggagcuggacccgccuuuuggagauuccuacaucgugaucggcgucggggaaaagaaaauuacccaucacuggcauagaagcggcucuacaaucggaaaggcuuucgaggccacggugcggggcgcgaaacgcauggcuguucucggggacaccgccugggauuuuggaagcugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9059 - RNA, 1582 nt, Artificial Sequence
  KU501217.1 solE mRNA Design 3 opt
gggagaaagcuuaccaugagccagaaggugaucuaccuggucaugauucuccugaucgcccccgcuuauuccauuagaugcaucggcguuucuaaccgggacuucguggaggggaugagcggaggcaccuggguggaugucgugcuugaacacgggggauguguuacagugauggcccaagacaaaccuacggucgauauugagcuggugaccacaaccguuuccaauauggcggaaauccgcucuuacugcuaugaggcuagcaucuccgacauggccucugauagcagauguccgacacagggcgaagccuaccucgacaagcaguccgauacccaguaugugugcaaacggacacuggucgaccgcggguggggaaacggcuguggccuuuuugggaagggaagccuggugaccugcgcuaaauucgccuguucuaagaagaugacgggcaaauccauucaacccgagaaucucgaguacagaaucaugcugagcgugcaugggucucagcacuccggaaugauugucaacgauaccggccaugaaacagacgagaaucgggcuaagguugaaaucaccccuaacagcccccgcgccgaggcgacacucgggggauuuggcucucugggccuggauugcgagccuagaaccgggcuugacuucuccgaucuguauuaccucacgaugaauaacaaacacuggcuggugcauaaggaaugguuucacgacauuccccuuccuuggcacgccggagcugacacaggcaccccgcauuggaauaacaaagaggcccugguggaguucaaggaugcucacgccaagcggcagacagucgugguucucgggagccaggaaggagcggugcauaccgcccuggcuggcgcccuggaagcugagauggacggggccaaaggacgccucuccucuggccaccugaaguguagacuuaaaauggauaagcugcggcucaaaggcgucagcuacucccugugcaccgccgcuuuuacauucacgaagauccccgcggagacccuucacgggacagugaccguugaagugcaauaugccggaacagacggcccuuguaaaguccccgcucagauggccguggauaugcagacccugacgccugucgggcgccucauuacagccaaucccgugaucaccgagagcaccgaaaacucuaagaugaugcuggagcuggacccgccuuuuggagauuccuacaucguuauuggcgugggggaaaagaaaaucacacaucacuggcauagaagcggcucuaccauuggaaaggcuuucgaggccacaguccggggcgcgaaacgcauggcugugcucggggacacggccugggauuuuggaagcugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9060 - RNA, 1582 nt, Artificial Sequence
  KU761561.1 solE mRNA Design 3 opt
gggagaaagcuuaccaugagccagaaggugaucuaccuggucaugauucuccugaucgcccccgcuuauuccauuagaugcaucggcguuucuaaccgggacuucguggaggggaugagcggaggcaccuggguggaugucgugcuugaacacgggggauguguuacagugauggcccaagacaaaccuacggucgauauugagcuggugaccacaaccguuuccaauauggcggaagugcgcucuuacugcuaugaggcuagcaucuccgacauggccucugauagcagauguccgacacagggcgaagccuaccucgacaagcaguccgauacccaguaugucugcaaacggacacugguggaccgcggguggggaaacggcuguggccuuuuugggaagggaagccuggugaccugcgcuaaauucgccuguucuaagaagaugacgggcaaauccauccaacccgagaaucucgaguacagaauuaugcugagcguccaugggucucagcacuccggaaugaucguuaacgauaccggccaugaaacagacgagaaucgggcuaagguggaaauuaccccuaacagcccccgcgccgaggcgacacucgggggauuuggcucucugggccuggauugcgagccuagaaccgggcuugacuucuccgaucuguauuaccucacgaugaauaacaaacacuggcuggugcauaaggaaugguuucacgacaucccccuuccuuggcacgccggagcugacacaggcaccccgcauuggaauaacaaagaggcccuggucgaguucaaggaugcucacgccaagcggcagacagugguugugcucgggagccaggaaggagcgguccauaccgcccuggcuggcgcccuggaagcugagauggacggggccaaaggacgccucuccucuggccaccugaaguguagacuuaaaauggauaagcugcggcucaaaggcgugagcuacucccugugcaccgccgcuuuuacauucacgaagauucccgcggagacccuucacgggacaguuaccguggaaguccaauaugccggaacagacggcccuuguaaagugcccgcucagauggccgucgauaugcagacccugacgccuguggggcgccucaucacagccaaucccguuauuaccgagagcaccgaaaacucuaagaugaugcuggagcuggacccgccuuuuggagauuccuacaucgugaucggcgucggggaaaagaaaauuacacaucacuggcauagaagcggcucuaccaucggaaaggcuuucgaggccacagugcggggcgcgcgcagaauggcuguucucggggacacggccugggauuuuggaagcugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9061 - RNA, 1582 nt, Artificial Sequence
  KY075937.1 solE mRNA Design 3 opt
gggagaaagcuuaccaugagccagaaggugaucuaccuggucaugauucuccugaucgcccccgcuuauuccauuagaugcaucggcguuucuaaccgggacuucguggaggggaugagcggaggcaccuggguggaugucgugcuugaacacgggggauguguuacagugauggcccaagacaaaccuacggucgauauugagcuggugaccacaaccguuuccaauauggcggaagugcgcucuuacugcuaugaggcuagcaucuccgacauggucucugauagcagauguccgacacagggcgaagccuaccucgacaagcaguccgauacccaguaugugugcaaacggacacugguggaccgcggguggggaaacggcuguggccuuuuugggaagggaagccugguuaccugcgccaaauucgcuuguucuaagaagaugacgggcaaauccauccaacccgagaaucucgaguacagaauuaugcugagcguccaugggucucagcacuccggaaugaucgugaacgauaccggccaugaaacagacgagaaucgggccaagguggaaauuaccccuaacagcccccgcgcugaggccacacucgggggauuuggcucucugggccuggauugcgagccuagaaccgggcuugacuucuccgaucuguauuaccucacgaugaauaacaaacacuggcugguccauaaggaaugguuucacgacaucccccuuccuuggcacgcgggagccgacacaggcaccccgcauuggaauaacaaagaggcucugguggaguucaaggaugcccacgcuaagcggcagacaguugugguccucgggagccaggaaggagccgugcauaccgcgcuggccggcgcucuggaagccgagauggacggggcuaaaggacgccucuccucuggccaccugaaguguagacuuaaaauggauaagcugcggcucaaaggcguuagcuacucccugugcaccgccgccuuuacauucacgaagauucccgcugagacccuucacgggacagugaccgucgaagugcaauaugcgggaacagacggcccuuguaaaguccccgcccagauggcuguggauaugcagacccugacgccuguugggcgccucaucacagccaaucccgugauuaccgagagcaccgaaaacucuaagaugaugcuggagcuggacccgccuuuuggagauuccuacaucgucaucggcgugggggaaaagaaaauuacacaucacuggcauagaagcggcucuaccaucggaaaggccuucgaggcuacaguucggggcgccaaacgcauggcggugcucggggacacggcuugggauuuuggaagcugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9062 - RNA, 1582 nt, Artificial Sequence
  KY014317.1 solE mRNA Design 3 opt
gggagaaagcuuaccaugagccagaaggugaucuaccuggucaugauucuccugaucgcccccgcuuauuccauuagaugcaucggcguuucuaaccgggacuucguggaggggaugagcggaggcaccuggguggaugucgugcuugaacacgggggauguguuacagugauggcccaagacaaaccuacggucgauauugagcuggugaccacaaccguuuccaauauggcggaagugcgcucuuacugcuaugaggcuagcaucuccgacauggccucugauagcagauguccgacacagggcgaagccuaccucgacaagcaguccgauacccaguaugucugcaaacggacacugguggaccgcggguggggaaacggcuguggccuuuuugggaagggaagccuggugaccugcgcuaaauucgccuguucuaagaagaugacgggcaaauccauccaacccgagaaucucgaguacagaauuaugcugagcguccaugggucucagcacuccggaaugaucguuaacgauaccggccaugaaacagacgagaaucgggcuaagguggaaauuaccccuaacagcccccgcgccgaggcgacacucgggggauuuggcucucugggccuggauugcgagccuagaaccgggcuugacuucuccgaucuguauuaccucacgaugaauaacaaacacuggcuggugcauaaggaaugguuucacgacaucccccuuccuuggcacgccggagcugacacaggcaccccgcauuggaauaacaaagaggcccuggucgaguucaaggaugcucacgccaagcggcagacagugguugugcucgggagccaggaaggagcgguccauaccgcccuggcuggcgcccuggaagcugagauggacggggccaaaggacgccucuccucuggccaccugaaguguagacuuaaaauggauaagcugcggcucaaaggcgugagcuacucccugugcaccgccgcuuuuacauucacgaagauucccgcggagacccuucacgggacaguuaccguggaaguccaauaugccggaacagacggcccuuguaaagugcccgcucagauggccgucgauaugcagacccugacgccuguggggcgccucaucacagccaaucccguuauuaccgagagcaucgaaaacucuaagaugaugcuggagcuggacccgccuuuuggagauuccuacaucgugauuggcgucggggaaaagaaaaucacccaucacuggcauagaagcggcucuacaauuggaaaggcuuucgaggccaccgugcggggcgcgaaacgcauggcuguucucggggacacagccugggauuuuggaagcugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9063 - RNA, 1582 nt, Artificial Sequence
  KU870645.1 solE mRNA Design 3 opt
gggagaaagcuuaccaugagccagaaggugaucuaccuggucaugauucuccugaucgcccccgcuuauuccauuagaugcaucggcguuucuaaccgggacuucguggaggggaugagcggaggcaccuggguggaugucgugcuugaacacgggggauguguuacagugauggcccaagacaaaccuacggucgauauugagcuggugaccacaaccguuuccaauauggcggaagugcgcucuuacugcuaugaggcuagcaucuccgacauggccucugauagcagauguccgacacagggcgaagccuaccucgacaagcaguccgauacccaguaugucugcaaacggacacugguggaccgcggguggggaaacggcuguggccuuuuugggaagggaagccuggugaccugcgcuaaauucgccuguucuaagaagaugacgggcaaauccauccaacccgagaaucucgaguacagaauuaugcugagcguccaugggucucagcacuccggaaugaucguuaacgauaccggccaugaaacagacgagaaucgggcuaagguggaaauuaccccuaacagcccccgcgccgaggcgacacucgggggauuuggcucucugggccuggauugcgagccuagaaccgggcuugacuucuccgaucuguauuaccucacgaugaauaacaaacacuggcuggugcauaaggaaugguuucacgacaucccccuuccuuggcacgccggagcugacacaggcaccccgcauuggaauaacaaagaggcccuggucgaguucaaggaugcucacgccaagcggcagacagugguugugcucgggagccaggaaggagcgguccauaccgcccuggcuggcgcccuggaagcugagauggacggggccaaaggacgccucuccucuggccaccugaaguguagacuuaaaauggauaagcugcggcucaaaggcgugagcuacucccugugcaccgccgcuuuuacauucacgaagauucccgcggagacccuucacgggacaguuaccguggaaguccaauaugccggaacagacggcccuuguaaagugcccgcucagauggccgucgauaugcagacccugacgccuguggggcgccucaucacagccaaucccguuauuaccgagagcaccgaaaacucuaagaugaugcuggagcuggacccgccuuuuggagauuccuacaucgugaucggcauuggggaaaagaaaaucacacaucacuggcauagaagcggcucuaccauuggaaaggcuuucgaggccacaguccggggcgcgaaacgcauggcugugcucggggacacggccugggauuuuggaagcugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9064 - RNA, 1582 nt, Artificial Sequence
  KU922923.1 solE mRNA Design 3 opt
gggagaaagcuuaccaugagccagaaggugaucuaccuggucaugauucuccugaucgcccuugcuuauuccauuagaugcaucggcguuucuaaccgggacuucguggaggggaugagcggaggcaccuggguggaugucgugcuggaacacgggggauguguuacagugauggcccaagacaaacccacggucgauauugagcucgugaccacaaccguuuccaauauggcggaagugcgcucuuacugcuaugaggcuagcaucuccgacauggccucugauagcagauguccuacacagggcgaagccuaccuggacaagcaguccgauacccaguaugucugcaaacggacacuuguggaccgcggguggggaaacggcuguggccuguuugggaagggaagccucgugaccugcgcuaaauucgccuguucuaagaagaugacgggcaaauccauccaaccggagaaucuggaguacagaauuaugcugagcguccaugggucucagcacuccggaaugaucguuaacgauaccggccaugaaacagacgagaaucgggcuaagguggaaauuacccccaacagcccucgcgccgaggcgacacucgggggauuuggcucucugggccuugauugcgagcccagaaccgggcuggacuucuccgaucucuauuaccugacgaugaauaacaaacacuggcuugugcauaaggaaugguuucacgacaucccucugcccuggcacgccggagcugacacaggcaccccucauuggaauaacaaagaggcccucgucgaguucaaggaugcucacgccaagcggcagacagugguugugcuggggagccaggaaggagcgguccauaccgcccuggcuggcgcccucgaagcugagauggacggggccaaaggacgccuguccucuggccaccuuaaguguagacugaaaauggauaagcuccggcugaaaggcgugagcuacucccuuugcaccgccgcuuuuacauucacgaagauuccggcggagacccugcacgggacaguuaccguggaaguccaauaugccggaacagacggccccuguaaagugccugcucagauggccgucgauaugcagacccucacgcccguggggcgccugaucacagccaauccuguuauuaccgagagcaccgaaaacucuaagaugaugcuggagcucgaucccccguuuggagacuccuacaucgugaucggcgucggggaaaagaaaauuacacaucacuggcauagaagcggcucuaccaucggaaaggcuuucgaggccacagugcggggcgcgaaacgcauggcuguucugggggacacggccugggauuuuggaagcugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9065 - RNA, 1582 nt, Artificial Sequence
  KU497555.1 solE mRNA Design 3 opt
gggagaaagcuuaccaugagccagaaggugaucuaccuggucaugauucuccugaucgcccccgcuuauuccauuagaugcaucggcguuucuaaccgggacuucguggaggggaugagcggaggcaccuggguggaugucgugcuugaacacgggggauguguuacagugauggcccaagacaaaccuacggucgauauugagcuggugaccacaaccguuuccaauauggcggaagugcgcucuuacugcuaugaggcuagcaucuccgacauggccucugauagcagauguccgacacagggcgaagccuaccucgacaagcaguccgauacccaguaugucugcaaacggacacugguggaccgcggguggggaaacggcuguggccuuuuugggaagggaagccuggugaccugcgcuaaauucgccuguucuaagaagaugacgggcaaauccauccaacccgagaaucucgaguacagaauuaugcugagcguccaugggucucagcacuccggaaugaucguuaacgauaccggccaugaaacagacgagaaucgggcuaagguggaaauuaccccuaacagcccccgcgccgaggcgacacucgggggauuuggcucucugggccuggauugcgagccuagaaccgggcuugacuucuccgaucuguauuaccucacgaugaauaacaaacacuggcuggugcauaaggaaugguuucacgacaucccccuuccuuggcacgccggagcugacacaggcaccccgcauuggaauaacaaagaggcccuggucgaguucaaggaugcucacgccaagcggcagacagugguugugcucgggacccaggaaggagcgguccauaccgcccuggcuggcgcccuggaagcugagauggacggggccaaaggacgccucagcuccggccaccugaaguguagacuuaaaauggauaagcugcggcucaaaggcgugucuuacagccugugcacagccgcuuuuacguucaccaagauucccgcggagacacuucacgggaccguuacaguggaaguccaauaugccggaaccgacggcccuuguaaagugcccgcucagauggccgucgauaugcagacgcugacaccuguggggcgccucaucaccgccaaucccguuauuaccgaguccacagaaaacagcaagaugaugcuggagcuggacccgccuuuuggagauucuuacaucgugaucggcgucggggaaaagaaaauuacccaucacuggcauagauccggcagcacaaucggaaaggcuuucgaggccacggugcggggcgcgaaacgcauggcuguucucggggacaccgccugggauuuuggaucuugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9066 - RNA, 1582 nt, Artificial Sequence
  KU312314.1 solE mRNA Design 3 opt
gggagaaagcuuaccaugagccagaaggugaucuaccuggucaugauucuccugaucgcccccgcuuauuccauuagaugcaucggcguuucuaaccgggacuucguggaggggaugagcggaggcaccuggguggaugucgugcuugaacacgggggauguguuacagugauggcccaagacaaaccuacggucgauauugagcuggugaccacaaccguuuccaauauggcggaagugcgcucuuacugcuaugaggcuagcaucuccgacauggccucugauagcagauguccgacacagggcgaagccuaccucgacaagcaguccgauacccaguaugucugcaaacggacacugguggaccgcggguggggaaacggcuguggccuuuuugggaagggaagccuggugaccugcgcuaaauucgccuguucuaagaagaugacgggcaaauccauccaacccgagaaucucgaguacagaauuaugcugagcguccaugggucucagcacuccggaaugaucguuaacgauaccggccaugaaacagacgagaaucgggcuaagguggaaauuaccccuaacagcccccgcgccgaggcgacacucgggggauuuggcucucugggccuggauugcgagccuagaaccgggcuugacuucuccgaucuguauuaccucacgaugaauaacaaacacuggcuggugcauaaggaaugguuucacgacaucccccuuccuuggcacgccggagcugacacaggcaccccgcauuggaauaacaaagaggcccuggucgaguucaaggaugcucacgccaagcggcagacagugguugugcucgggagccaggaaggagcgguccauaccgcccuggcuggcgcccuggaagcugagauggacggggccaaaggacgccucuccucuggccaccugaaguguagacuuaaaauggauaagcugcggcucaaaggcgugagcuacucccugugcaccgccgcuuuuacauucacgaagauucccgcggagacccuucacgggacaguuaccguggaaguccaauaugccggaacagacggcccuuguaaagugcuggcucagauggccgucgauaugcagacccucacgcccguggggcgccugaucacagccaauccuguuauuaccgagagcaccgaaaacucuaagaugaugcuggagcucgaucccccguuuggagacuccuacaucgugaucggcgucggggaaaagaaaauuacacaucacuggcauagaagcggcucuaccaucggaaaggcuuucgaggccacagugcggggcgcgaaacgcauggcuguucugggggacacggccugggauuuuggaagcugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9067 - RNA, 1582 nt, Artificial Sequence
  KY014314.1 solE mRNA Design 3 opt
gggagaaagcuuaccaugagccagaaggugaucuaccuggucaugauucuccugaucgcccccgcuuauuccauuagaugcaucggcguuucuaaccgggacuucguggaggggaugagcggaggcaccuggguggaugucgugcuugaacacgggggauguguuacagugauggcccaagacaaaccuacggucgauauugagcuggugaccacaaccguuuccaauauggcggaagugcgcucuuacugcuaugaggcuagcaucuccgacauggccucugauagcagauguccgacacagggcgaagccuaccucgacaagcaguccgauacccaguaugucugcaaacggacacugguggaccgcggguggggaaacggcuguggccuuuuugggaagggaagccuggugaccugcgcuaaauucgccuguucuaagaagaugacgggcaaauccauccaacccgagaaucucgaguacagaauuaugcugagcguccaugggucucagcacuccggaaugaucguuaacgauaccggccaugaaacagacgagaaucgggcuaagguggaaauuaccccuaacagcccccgcgccgaggcgacacucgggggauuuggcucucugggccuggauugcgagccuagaaccgggcuugacuucuccgaucuguauuaccucacgaugaauaacaaacacuggcuggugcauaaggaaugguuucacgacaucccccuuccuuggcacgccggagcugacacaggcaccccgcauuggaauaacaaagaggcccuggucgaguucaaggaagcucacgccaagcggcagacagugguugugcucgggagccaggaaggagcgguccauaccgcccuggcuggcgcccuggaggcugagauggauggggccaaaggacgccucuccucuggccaccugaaguguagacuuaaaauggacaagcugcggcucaaaggcgugagcuacucccugugcaccgccgcuuuuacauucacgaagauucccgcggaaacccuucacgggacaguuaccguggagguccaauaugccggaacagauggcccuuguaaagugcccgcucagauggccgucgacaugcagacccugacgccuguggggcgccucaucacagccaaucccguuauuaccgaaagcaccgagaacucuaagaugaugcuggaacuggauccgccuuuuggagacuccuacaucgugaucggcgucggggagaagaaaauuacacaucacuggcauagaagcggcucuaccaucggaaaggcuuucgaggccacagugcggggcgcgaaacgcauggcuguucucggggauacggccugggacuuuggaagcugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9068 - RNA, 1582 nt, Artificial Sequence
  KX447517.1 solE mRNA Design 3 opt
gggagaaagcuuaccaugagccagaaggugaucuaccuggucaugauucuccugaucgcccccgcuuauuccauuagaugcaucggcguuucuaaccgggacuucguggaggggaugagcggaggcaccuggguggaugucgugcuugaacacgggggauguguuacagugauggcccaagacaaaccuacggucgauauugagcuggugaccacaaccguuuccaauauggcggaagugcgcucuuacugcuaugaggcuagcaucuccgacauggccucugauagcagauguccgacacagggcgaagccuaccucgacaagcaguccgauacccaguaugucugcaaacggacacugguggaccgcggguggggaaacggcuguggccuuuuugggaagggaagccuggugaccugcgcuaaauucgccuguucuaagaagaugacgggcaaauccauccaacccgagaaucucgaguacagaauuaugcugagcguccaugggucucagcacuccggaaugaucguuaacgauaccggccaugaaacagacgagaaucgggcuaagguggaaauuaccccuaacagcccccgcgccgaggcggcccucgggggauuuggcucucugggccuggauugcgagccuagaacagggcuugacuucuccgaucuguauuaccucaccaugaauaacaaacacuggcuggugcauaaggaaugguuucacgacaucccccuuccuuggcacgcuggagccgacacgggcacaccgcauuggaauaacaaagaggcucuggucgaguucaaggaugcccacgcgaagcggcagaccgugguugugcucgggagccaggaaggagccguccauacagcucuggccggcgcucuggaagccgagauggacggggccaaaggacgccucuccucuggccaccugaaguguagacuuaaaauggauaagcugcggcucaaaggcgugagcuacucccugugcaccgcugcguuuaccuucacaaagauucccgccgagacgcuucacgggaccguuacaguggaaguccaauaugcuggaaccgacggcccuuguaaagugcccgcccagauggccgucgauaugcagacacugaccccuguggggcgccucaucacggcuaaucccguuauuacagagagcaccgaaaacucuaagaugaugcuggagcuggacccgccuuuuggagauuccuacaucgugaucggcgucggggaaaagaaaauuacccaucacuggcauagaagcggcucuacaaucggaaaggccuucgaggcgaccgugcggggcgcuaaacgcauggccguucucggggacacagccugggauuuuggaagcugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9069 - RNA, 1582 nt, Artificial Sequence
  KU729217.2 solE mRNA Design 3 opt
gggagaaagcuuaccaugagccagaaggugaucuaccuggucaugauucuccugaucgcccccgcuuauuccauuagaugcaucggcguuucuaaccgggacuucguggaggggaugagcggaggcaccuggguggaugucgugcuugaacacgggggauguguuacagugauggcccaagacaaaccuacggucgauauugagcugguguccaccacaguuucuaauauggcggaagugcgcagcuacugcuaugaggcuaccaucuccgacaucgccucugauagcagauguccgacacagggcgaagccuaccucgacaagcaguccgauacccaguaugucugcaaacggacacugguggaccgcggguggggaaacggcuguggccuuuuugggaagggaagccuggugaccugcgcuaaauucgccuguucuaagaagaugacgggcaaauccauucaacccgagaaucucgaguacagaaucaugcugagcguccaugggucucagcacuccggaaugauuguuaacgauaccggccaugaaacagacgagaaucgggcuaagguggaaaucaccccuaacagcccccgcgccgaggcgacacucgggggauuuggcucucugggccuggauugcgagccuagaaccgggcuugacuucuccgaucuguauuaccucacgaugaauaacaaacacuggcuggugcauaaggaaugguuucacgacauuccccuuccuuggcacgccggagcugacacaggcaccccgcauuggaauaacaaagaggcccuggucgaguucaaggaugcucacgccaagcggcagacagcggugguucucgggagccaggaaggagccgugcauaccgcucuggccggcgcucuggaagccgagauggacggggccaaaggacgccucuccucuggccaccugaaguguagacuuaaaauggauaagcugcggcucaaaggcgucagcuacucccugugcaccgcugcguuuacauucacgaagauccccgccgagacccuucacgggacagugaccguugaagugcaauaugcuggaacagacggcccuuguaaaguccccgcccagauggccguggauaugcagacccugacgccugucgggcgccucauuacagcuaaucccgugaucaccgagagcaccgaaaacucuaagaugaugcuggagcuggacccgccuuuuggagauuccuacaucguuauuggcgugggggaaaagaaaaucacacaucacuggcauagaagcggcucuaccauuggaaaggccuucgaggcgacaguccggggcgcuaaacgcauggccgugcucggggacacggccugggauuuuggaagcugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9070 - RNA, 1582 nt, Artificial Sequence
  KY328290.1 solE mRNA Design 3 opt
gggagaaagcuuaccaugagccagaaggugaucuaccuggucaugauucuccugaucgcccccgcuuauuccauuagaugcaucggcguuucuaaccgggacuucguggaggggaugagcggaggcaccuggguggaugucgugcuugaacacgggggauguguuacagugauggcccaagacaaaccuacggucgauauugagcuggugaccacaaccguuuccaauauggcggaagugcgcucuuacugcuaugaggcuagcaucuccgacauggccucugauagcagauguccgacacagggcgaagccuaccucgacaagcaguccgauacccaguaugucugcaaacggacacugguggaccgcggguggggaaacggcuguggccuuuuugggaagggaagccuggugaccugcgcuaaauucgccuguucuaagaagaugacgggcaaauccauccaacccgagaaucucgaguacagaauuaugcugagcguccaugggucucagcacuccggaaugaucguuaacgauaccggccaugaaacagacgagaaucgggcuaagguggaaauuaccccuaacagcccccgcgccgaggcgacacucgggggauuuggcucucugggccuggauugcgagccuagaaccgggcuugacuucuccgaucuguauuaccucacgaugaauaacaaacacuggcuggugcauaaggaaugguuucacgacaucccccuuccuuggcacgccggagcugacacaggcaccccgcauuggaauaacaaagaggcccuggucgaguucaaggaugcucacgccaagcggcagacagugguugugcucgggagccaggaaggagcgguccauaccgcccuggcuggcgcccuggaagcugagauggacggggccaaaggacgccucuccucuggccaccugaaguguagacuuaaaauggauaagcugcggcucaaaggcgugagcuacucccugugcaccgccgcuuuuacauucagcaagauucccgcggagacgcuucacgggaccguuacagaagaggugcaauaugccggaaccgacggcccuuguaaaguccccgcucagauggccguggauaugcagacacugaccccugucgggcgccucaucacggccaaucccgugauuacagaaucuaccgagaacuccaagaugaugcuggaacuggacccgccuuuuggagauagcuacaucguuaucggcgugggggagaagaaaauuacccaucacuggcauagaucuggcagcacaaucggaaaggcuuucgaggccaccguccggggcgcgaaacgcauggcugugcucggggacacagccugggauuuuggauccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9071 - RNA, 1582 nt, Artificial Sequence
  KX087101.3 solE mRNA Design 3 opt
gggagaaagcuuaccaugagccagaaggugaucuaccuggucaugauucuccugaucgcccccgcuuauuccauuagaugcaucggcguuucuaaccgggacuucguggaggggaugagcggaggcaccuggguggaugucgugcuugaacacgggggauguguuacagugauggcccaagacaaaccuacggucgauauugagcuggugaccacaaccguuuccaauauggcggaagugcgcucuuacugcuaugaggcuagcaucuccgacauggccucugauagcagauguccgacacagggcgaagccuaccucgacaagcaguccgauacccaguaugucugcaaacggacacugguggaccgcggguggggaaacggcuguggccuuuuugggaagggaagccuggugaccugcgcuaaauucgccuguucuaagaagaugacgggcaaauccauccaacccgagaaucucgaguacagaauuaugcugagcguccaugggucucagcacuccggaaugaucguuaacgauaccggccaugaaacagacgagaaucgggcuaagguggaaauuaccccuaacagcccccgcgccgaggcgacacucgggggauuuggcucucugggccuggauugcgagccuagaaccgggcuugacuucuccgaucuguauuaccucacgaugaauaacaaacacuggcuggugcauaaggaaugguuucacgacaucccccuuccuuggcacgccggagcugacacaggcaccccgcauuggaauaacaaagaggcccuggucgaguucaaggaugcucacgccaagcggcagacagugguugugcucgggagccaggaaggagcgguccauaccgcccuggcuggcgcccuggaagcugagauggacggggccaaaggacgccucuccucuggccaccugaaguguagacuuaaaauggauaagcugcggcucaaaggcgugagcuacucccugugcaccgccgcuuuuacauucacgaagauucccgcggagacccuucacgggacaguuaccguggaacugcaauaugccggaacagacggcccuuguaaaguccccgcucagauggccguggauaugcagacccucacgccugucgggcgccugaucacagccaaucccgugauuaccgagagcaccgaaaacucuaagaugaugcuggagcucgacccgccuuuuggagauuccuacaucguuaucggcgugggggaaaagaaaauuacacaucacuggcauagaagcggcucuaccaucggaaaggcuuucgaggccacaguccggggcgcgaaacgcauggcugugcugggggacacggccugggauuuuggaagcugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9072 - RNA, 1582 nt, Artificial Sequence
  KY003156.1 solE mRNA Design 3 opt
gggagaaagcuuaccaugagccagaaggugaucuaccuggucaugauucuccugaucgcccccgcuuauuccauuagaugcaucggcauuucuaaccgggacuucguugaggggaugagcggaggcaccuggguggaugugguccuugaacacgggggaugugugacaguuauggcccaagacaaaccuacgguggauaucgagcuggucaccacaaccguguccaauauggcggaaguucgcucuuacugcuaugaggcuagcaucuccgacauggccucugauagcagauguccgacacagggcgaagccuaccucgacaagcaguccgauacccaguaugugugcaaacggacacuggucgaccgcggguggggaaacggcuguggccuuuuugggaagggaagccuggugaccugcgcuaaauucgccuguucuaagaagaugacgggcaaauccauucaacccgagaaucucgaguacagaaucaugcugagcgugcaugggucucagcacuccggaaugauugucaacgauaccggccaugaaacagacgagaaucgggcuaagguugaaaucaccccuaacagcccccgcgccgaggcgacacucgggggauuuggcauucugggccuggauugcgagccuagaaccgggcuugacuucucugaucuguauuaccucacgaugaauaacaaacacuggcuggugcauaaggaaugguuucacgacaucccccuuccuuggcacgccggagcugacacaggcaccccgcauuggaauaacaaagaggcccugguggaguucaaggaugcucacgccaagcggcagacagucgugguucucgggucccaggaaggagcggugcauaccgcccuggcuggcgcccuggaagcugagauggacggggccaaaggacgccucagcuccggccaccugaaguguagacuuaaaauggauaagcugcggcucaaaggcgucucuuacagccugugcaccgccgcuuuuacauucacgaagauucccgcggagacccuucacgggacagugaccguugaagugcaauaugccggaacagacggcccuuguaaaguccccgcucagauggccguggauaugcagacccugacgccugucgggcgccucaucacagccaaucccgugaucaccgaguccaccgaaaacagcaagaugaugcuggagcuggacccgccuuuuggagauucuuacauuguuaucggcgugggggaaaagaaaauuacacaucacuggcauagauccggcagcaccaucggaaaggcuuucgaggccacaguccggggcgcgaaacgcauggcugugcucggggacacggccugggauuuuggaucuugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9073 - RNA, 1582 nt, Artificial Sequence
  KU758876.1 solE mRNA Design 3 opt
gggagaaagcuuaccaugagccagaaggugaucuaccuggucaugauucuccugaucgcccccgcuuauuccauuagaugcaucggcguuucuaaccgggacuucguggaggggaugagcggaggcaccuggguggaugucgugcuugaacacgggggauguguuacagugauggcccaagacaaaccuacggucgauauugagcuggugaccacaaccguuuccaauauggcggaagugcgcucuuacugcuaugaggcuagcaucuccgacauggccucugauagcagauguccgacacagggcgaagccuaccucgacaagcaguccgauacccaguaugucugcaaacggacacugguggaccgcggguggggaaacggcuguggccuuuuugggaagggaagccuggugaccugcgcuaaauucgccuguucuaagaagaugacgggcaaauccauccaacccgagaaucucgaguacagaauuaugcugagcguccaugggucucagcacuccggaaugaucguuaacgauaccggccaugaaacagacgagaaucgggcuaagguggaaauuaccccuaacagcccccgcgccgaggcgacacucgggggauuuggcucucugggccuggauugcgagccuagaaccgggcuugacuucuccgaucuguauuaccucacgaugaauaacaaacacuggcuggugcauaaggaaugguuucacgacaucccccuuccuuggcacgccggagcugacacaggcaccccgcauuggaauaacaaagaggcccuggucgaguucaaggaugcucacgccaagcggcagacagugguugugcucgggagccaggaaggagcgguccauaccgcccuggcuggcgcccuggaagcugagauggacggggugaaaggacgccucuccucuggccaccugaaguguagacuuaaaauggauaagcugcggcucaaaggcguuagcuacucccugugcaccgccgccuuuacauucacgaagauucccgcugagacccuucacgggacagugaccgucgaagugcaauaugcgggaacagacggcccuuguaaaguccccgcccagauggcuguggauaugcagacccugacgccuguugggcgccucaucacagccaaucccgugauuaccgagagcaccgaaaacucuaagaugaugcuggagcuggacccgccuuuuggagauuccuacaucgucaucggcgugggggaaaagaaaauuacacaucacuggcauagaagcggcucuaccaucggaaaggccuucgaggcuacaguucggggcgccaaacgcauggcggugcucggggacacggcuugggauuuuggaagcugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9074 - RNA, 1582 nt, Artificial Sequence
  KU926310.1 solE mRNA Design 3 opt
gggagaaagcuuaccaugagccagaaggugaucuaccuggucaugauucuccugaucgcccccgcuuauuccauuagaugcaucggcguuucuaaccgggacuucguggaggggaugagcggaggcaccuggguggaugucgugcuugaacacgggggauguguuacagugauggcccaagacaaaccuacggucgauauugagcuggugaccacaaccguuuccaauauggcggaagugcgcucuuacugcuaugaggcuagcaucuccgacauggccucugauagcagauguccgacacagggcgaagccuaccucgacaagcaguccgauacccaguaugucugcaaacggacacugguggaccgcggguggggaaacggcuguggccuuuuugggaagggaagccuggugaccugcgcuaaauucgccuguucuaagaagaugacgggcaaauccauccaacccgagaaucucgaguacagaauuaugcugagcguccaugggucucagcacuccggaaugaucguuaacgauaccggccaugaaacagacgagaaucgggcuaagguggaaauuaccccuaacagcccccgcgccgaggcgacacucgggggauuuggcucucugggccuggauugcgagccuagaaccgggcuugacuucuccgaucuguauuaccucacgaugaauaacaaacacuggcuggugcauaaggaaugguuucacgacaucccccuuccuuggcacgccggagcugacacaggcaccccgcauuggaauaacaaagaggcccuggucgaguucaaggaugcucacgccaagcggcagacagugguugugcucgggagccaggaaggagcgguccauaccgcccuggcuggcgcccuggaagcugagauggacggggccaaaggacgccucuccucuggccaccugaaguguagacuuaaaauggauaagcugcggcucaaaggcgugagcuacucccugugcaccgccgcuuuuacauucacgaagauucccgcggagacccuucacgggacaguuaccguggaaguccaauaugccggagcugacggcccuuguaaagugcccgcccagauggccgucgauaugcagacacugaccccuguggggcgccucaucacggcuaaucccguuauuacagagagcaccgaaaacucuaagaugaugcuggagcuggacccgccuuuuggagauuccuacaucgugaucggcgucggggaaaagaaaauuacccaucacuggcauagaagcggcucuacaaucggaaaggccuucgaggcgaccgugcggggcgcuaaacgcauggccguucucggggacacagccugggauuuuggaagcugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9075 - RNA, 1582 nt, Artificial Sequence
  KU681081.3 solE mRNA Design 3 opt
gggagaaagcuuaccaugagccagaaggugaucuaccuggucaugauucuccugaucgcccccgcuuauuccauuagaugcaucggcguuucuaaccgggacuucguggaggggaugagcggaggcaccuggguggaugucgugcuugaacacgggggauguguuacagugauggcccaagacaaaccuacggucgauauugagcuggugaccacaaccguuuccaauauggcggaagugcgcucuuacugcuaugaggcuagcaucuccgacauggccucugauagcagauguccgacacagggcgaagccuaccucgacaagcaguccgauacccaguaugucugcaaacggacacugguggaccgcggguggggaaacggcuguggccuuuuugggaagggaagccuggugaccugcgcuaaauucgccuguucuaagaagaugacgggcaaauccauccaacccgagaaucucgaguacagaauuaugcugagcguccaugggucucagcacuccggaaugaucguuaacgauaccggccaugaaacagacgagaaucgggcuaagguggaaauuaccccuaacagcccccgcgccgaggcgacacucgggggauuuggcucucugggccuggauugcgagccuagaaccgggcuugacuucuccgaucuguauuaccucacgaugaauaacaaacacuggcuggugcauaaggaaugguuucacgacaucccccuuccuuggcacacaggagccgacaccggcacaccgcauuggaauaacaaagaggcucuggucgaguucaaggaugcccacgcuaagcggcagaccgugguugugcucgggagccaggaaggagccguccauaccgcgcuggccggcgcucuggaagccgagauggacggggcuaaaggacgccucuccucuggccaccugaaguguagacuuaaaauggauaagcugcggcucaaaggcgugagcuacucccugugcacagccgccuuuacguucaccaagauucccgcugagacacuucacgggaccguuacaguggaaguccaauaugcgggaaccgacggcccuuguaaagugcccgcccagauggcugucgauaugcagacgcugacaccuguggggcgccucaucaccgccaaucccguuauuaccgagggaacagaaaacagcaagaugaugcuggagcuggacccgccuuuuggcgauucuuacaucgugaucggggucggcgaaaagaaaauuacccaucacuggcauagauccggaagcacaaucggcaaggccuucgaggcuacggugcgcggggccaaacggauggcgguucucggagacaccgcuugggauuuuggcucuugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9076 - RNA, 1582 nt, Artificial Sequence
  KU744693.1 solE mRNA Design 3 opt
gggagaaagcuuaccaugagccagaaggugaucuaccuggucaugauucuccugaucgcccccgcuuauuccauuagaugcaucggcguuucuaaccgggacuucguggaggggaugagcggaggcaccuggguggaugucgugcuugaacacgggggauguguuacagccauggcgcaagacaaaccuacgguggauauugagcuggucaccacaaccguguccaauauggcugaaguucgcucuuacugcuaugaggccagcaucuccgacauggccucugauagcagauguccgacacagggcgaggcuuaccucgacaagcaguccgauacccaguaugugugcaaacggacacuggucgaccgcggguggggaaacggcuguggccuuuuugggaagggaagccuggugaccugcgccaaauucgcuuguucuaagaagaugacgggcaaauccauccaacccgaaaaucucgaguacagaauuaugcugagcgugcaugggucucagcacuccggaaugcuggucaacgauaccggccaugaaacagacgagaaucgggccaagguugaaaucaccccuaacagcccccgcgcggaggccacacucgggggauuuggcucucugggccuugauugcgagccuagaaccgggcuggacuucuccgaucucuauuaccugacgaugaauaacaaacacuggcuugcucauaaggaaugguuucacgacauuccccugccuuggcacgccggagcugccacaggcaccccgcauuggaauaacaaagaggcgcucguggaguucaaggacgcccacgcuaagcggcagacaguggucgugcuggggagccaggaaggagccguucauaccgcucuggccggcgcccucgaagcugagauggauggggcgaaaggacgccuguccucuggccaccuuaaguguagacugaaaauggacaagcuccggcugaaaggcgugagcuacucccuuugcaccgccgcuuuuacauucacgaagauccccgccgagaccgucgaugggacagugaccguugaaggacaauauggcgggacagacggaccuuguaaagugcccgcccagauggcugucgauaugcagacccugacgccugugggccgccucauuacagccaaucccgucaucaccgagagcaccgaaaacucuaagaugaugcuggagcuggacccgccuuuuggggauuccuacauugugaucggcguuggagaaaagaaaaucacacaccauuggcacagaagcggcucuaccauugggaaggcguucgaggcuacagugcggggagccaaacgcauggccguccucggcgacacggcuugggauuuugggagcugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9077 - RNA, 1582 nt, Artificial Sequence
  EU545988.1 solE mRNA Design 3 opt
gggagaaagcuuaccaugagccagaaggugaucuaccuggucaugauucuccugaucgcccccgcuuauuccauuagaugcaucggcguuucuaaccgggacuucguggaggggaugagcggaggcaccuggguggaugucgugcuugaacacgggggauguguuacagugauggcccaagacaaaccugcggucgauauugagcuggugacgaccacaguuuccaauauggcugaagugcgcucuuacugcuaugaggccagcaucuccgacauggccucugauagcagauguccgacccagggcgaggcuuaccucgacaagcaguccgauacacaguaugucugcaaacggacccugguggaccgcggguggggaaacggcuguggccuuuuugggaagggaagccuggugacaugcgccaaauucgcuuguucuaagaagaugaccggcaaauccauccaacccgaaaaucucgaguacagaauuaugcugagcguccaugggucucagcacuccggaaugaucguuaacgauacgggccaugaaaccgacgagaaucgggccaagguggaaauuacaccuaacagcccccgcgcggaggccacccucgggggauuuggcucucugggccuggauugcgagccuagaacagggcuugacuucuccgaucuguauuaccucaccaugaauaacaaacacuggcuggugcauaaggaaugguuucacgacaucccccuuccuuggcacgcuggagccgacacgggcacaccgcauuggaauaacaaagaggcucuggucgaguucaaggaugcccacgcgaagcggcagaccgugguugugcucgggagccaggaaggagccguccauacagcucuggccggcgcucuggaagccgagauggacggggccaaaggacgccucuccucuggccaccugaaguguagacuuaaaauggauaagcugcggcucaaaggcgugagcuacucccugugcaccgcugcguuuaccuucacaaagauucccgccgagacgcuucacgggaccguuacaguggaaguccaauaugcuggaaccgacggcccuuguaaagugcccgcccagauggccgucgauaugcagacacugaccccuguggggcgccucaucacggcuaaucccguuauuacagagagcaccgaaaacucuaagaugaugcuggagcuggacccgccuuuuggagauuccuacaucgugaucggcgucggggaaaagaaaauuacccaucacuggcauagaagcggcucuacaaucggaaaggccuucgaggcgaccgugcggggcgcuaaacgcauggccguucucggggacacagccugggauuuuggaagcugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9078 - RNA, 1582 nt, Artificial Sequence
  KY007221.1 solE mRNA Design 3 opt
gggagaaagcuuaccaugagccagaaggugaucuaccuggucaugauucuccugaucgcccccgcuuauuccauuagaugcaucggcguuaacaaucgggacuucguggaggggaugucuggaggcaccuggguggaugucgugcuugaacacgggggauguguuacagugauggcccaagacaaaccuacggucgauauugagcuggugaccacaaccguuagcaacauggcggaagugcgcuccuacugcuaugaggcuucuaucagcgacauggccuccgauucuagauguccgacacagggcgaagccuaccucgacaagcagagcgauacccaguaugucugcaaacggacacugguggaccgcggguggggaaauggcuguggccuuuuugggaagggaucccuggugaccugcgcuaaauucgccuguagcaagaagaugacgggcaaaucuauccaacccgagaaccucgaguacagaauuaugcuguccguccaugggagccagcacucuggaaugaucguuaaugauaccggccaugaaacagacgagaaccgggcuaagguggaaauuaccccuaauagcccccgcgccgaggcgacacucgggggauuuggcucccugggccuggauugcgagccuagaaccgggcuugacuucucugaucuguauuaccucacgaugaacaauaaacacuggcuggugcauaaggaaugguuucacgacaucccccuuccuuggcacgccggagcugacacaggcaccccgcauuggaacaauaaagaggcccuggucgaguucaaggaugcucacgccaagcggcagacagugguugugcucgggucccaggaaggagcgguccauaccgcccuggcuggcgcccuggaagcugagauggacggggccaaaggacgccucagcuccggccaccugaaguguagacuuaaaauggauaagcugcggcucaaaggcgugucuuacagccugugcaccgccgcuuuuacauucacgaagauucccgcggagacccuucacgggacaguuaccguggaaguccaauaugccggaacagacggcccuuguaaagugcccgcucagauggccgucgauaugcagacccugacgccuguggggcgccucaucacagccaaccccguuauuaccgaguccaccgaaaauagcaagaugaugcuggagcuggacccgccuuuuggagauucuuacaucgugaucggcgucggggaaaagaaaauuacacaucacuggcauagauccggcagcaccaucggaaaggcuuucgaggccacagugcggggcgcgaaacgcauggcuguucucggggacacggccugggauuuuggaucuugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9079 - RNA, 1582 nt, Artificial Sequence
  KY003152.1 solE mRNA Design 3 opt
gggagaaagcuuaccaugagccagaaggugaucuaccuggucaugauucuccugaucgcccccgcuuauuccauuagaugcaucggcguuucuaaccgggacuucguggaggggaugagcggaggcaccuggguggaugucgugcuugaacacgggggauguguuacagugauggcccaagacaaaccuacggucgauauugagcuggugaccacaaccguuuccaauauggcggaagugcgcucuuacugcuaugaggcuagcaucuccgacauggccucugauagcagauguccgacacagggcgaagccuaccucgacaagcaguccgauacccaguaugucugcaaacggacacugguggaccgcggguggggaaacggcuguggccuuuuugggaagggaagccuggugaccugcgcuaaauucgccuguucuaagaagaugacgggcaaauccauccaacccgagaaucucgaguacagaauuaugcugagcguccaugggucucagcacuccggaaugaucguuaacgauaccggccaugaaacagacgagaaucgggcuaagguggaaauuaccccuaacagcccccgcgccgaggcgacacucgggggauuuggcucucugggccuggauugcgagccuagaaccgggcuugacuucuccgaucuguauuaccucacgaugaauaacaaacacuggcuggugcauaaggaaugguuucacgacaucccccuuccuuggcacgccggagcugacacaggcaccccgcauuggaauaacaaagaggcccuggucgaguucaaggaugcucacgccaagcggcagacagugguugugcucgggagccaggaaggagcgguccauaccgcccuggcuggcgcccuggaagcugagauggacggggccaaaggacgccucuccucuggccaccugaaguguagacuuaaaauggauaagcugcggcucaaaggcgugagcuacucccugugcgccgcugcguuuaccuucacaaagauucccgccgagacgcuucacgggaccguuacaguggaaguccaauaugcuggaaccgacggcccuuguaaagugcccgcccagauggccgucgauaugcagacacugaccccuguggggcgccucaucacggcuaaucccguuauuacagagagcaccgaaaacucuaagaugaugcuggagcuggacccgccuuuuggagauuccuacaucgugaucggcgucggggaaaagaaaauuacccaucacuggcauagaagcggcucuacaaucggaaaggccuucgaggcgaccgugcggggcgcuaaacgcauggccguucucggggacacagccugggauuuuggaagcugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9080 - RNA, 1582 nt, Artificial Sequence
  KX694533.2 solE mRNA Design 3 opt
gggagaaagcuuaccaugagccagaaggugaucuaccuggucaugauucuccugaucgcccccgcuuauuccauuagaugcaucggcguuucuaaccgggacuucguggaggggaugagcggaggcaccuggguggaugucgugcuugaacacgggggauguguuacagugauggcccaagacaaaccuacggucgauauugagcuggugaccacaaccguuuccaauauggcggaagugcgcucuuacugcuaugaggcuagcaucuccgacauggccucugauagcagauguccgacacagggcgaagccuaccucgacaagcaguccgauacccaguaugucugcaaacggacacugguggaccgcggguggggaaacggcuguggccuuuuugggaagggaagccuggugaccugcgcuaaauucgccuguucuaagaagaugacgggcaaauccauccaacccgagaaucucgaguacagaauuaugcugagcguccaugggucucagcacuccggaaugaucguuaacgauauuggccaugaaaccgacgagaaucgggcuaagguggaaaucacaccuaacagcccccgcgccgaggcgacccucgggggauuuggcucucugggccuggauugcgagccuagaacagggcuugacuucuccgaucuguauuaccucaccaugaauaacaaacacuggcuggugcauaaggaaugguuucacgacauuccccuuccuuggcacgccggagcugacacgggcacaccgcauuggaauaacaaagaggcccuggucgaguucaaggaugcucacgccaagcggcagaccgugguugugcucgggagccaggaaggagcgguccauacagcccuggcuggcgcccuggaagcugagauggacggggccaaaggacgccucuccucuggccaccugaaguguagacuuaaaauggauaagcugcggcucaaaggcgugagcuacucccugugcaccgccgcuuuuaccuucacaaagauccccgcggagacgcuucacgggaccguuacaguggaaguccaauaugccggaaccgacggcccuuguaaagugcccgcucagauggccgucgauaugcagacacugaccccuguggggcgccucauuacggccaaucccguuaucacagagagcaccgaaaacucuaagaugaugcuggagcuggacccgccuuuuggagauuccuacaucgugauuggcgucggggacaagaaaaucacccaucacuggcauagaagcggcucuacaauuggaaaggcuuucgaagccaccgugcggggcgcgaaacgcauggcuguucucggggauacagccugggacuuuggaagcugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9081 - RNA, 1582 nt, Artificial Sequence
  KX601167.1 solE mRNA Design 3 opt
gggagaaagcuuaccaugagccagaaggugaucuaccuggucaugauucuccugaucgcccccgcuuauuccauuagaugcaucggcguuucuaaccgggacuucguggaggggaugagcggaggcaccuggguggaugucgugcuugaacacgggggauguguuacagugauggcccaagacaaaccuacggucgauauugagcuggugaccacaaccguuuccaauauggcggaagugcgcucuuacugcuaugaggcuagcaucuccgacauggccucugauagcagauguccgacacagggcgaagccuaccucgacaagcaguccgauacccaguaugucugcaaacggacacugguggaccgcggguggggaaacggcuguggccuuuuugggaagggaagccuggugaccugcgcuaaauucgccuguucuaagaagaugacgggcaaauccauccaacccgagaaucucgaguacagaauuaugcugagcguccaugggucucagcacuccggaaugaucguuaacgauaccggccaugaaacagacgagaaucgggcuaagguggaaauuaccccuaacagcccccgcgccgaggcgacacucgggggauuuggcucucugggccuggauugcgagccuagaaccgggcuugacuucuccgaucuguauuaccucacgaugaauaacaaacacuggcuggugcauaaggaaugguuucacgacaucccccuuccuuggcacgccggagcugacacaggcaccccgcauuggaauaacaaagaggcccuggucgaguucaaggaugcucacgccaagcggcagacagugguugugcucgggagccaggaaggagcgguccauaccgcccuggcuggcgcccuggaagcugagauggacggggccaaaggacgccucuccucuggccaccugaaguguagacuuaaaauggauaagcugcggcucaaaggcgugagcuacucccugugcaccgccgcuuuuacauucacgaagauucccgcggagacccuucacgggacaguuaccguggaaguccaauaugccggaacagacggcccuuguaaagugcccgcucagauggccgucgauaugcagacccugacgccuguggggcgccucaucacagccaaucccguuauuaccgagagcaccgaaaacucuaagaugaugcuggagcuggacccgccuuuuggagauuccuacaucgugaucggcgucggggacaagaaaauuacacaucacugguauagaagcggcucuaccaucggaaaggcuuucgaagccacagugcggggcgcgaaacgcauggcuguucucggggauacggccugggacuuuggaagcugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9082 - RNA, 1582 nt, Artificial Sequence
  KY288905.1 solE mRNA Design 3 opt
gggagaaagcuuaccaugagccagaaggugaucuaccuggucaugauucuccugaucgcccccgcuuauuccauuagaugcaucggcguuucuaaccgggacuucguggaggggaugagcggaggcaccuggguggaugucgugcuugaacacgggggauguguuacagugauggcccaagacaaaccuacggucgauauugagcuggugaccacaaccguuuccaauauggcggaagugcgcucuuacugcuaugaggcuagcaucuccgacauggccucugauagcagauguccgacacagggcgaagccuaccucgacaagcaguccgauacccaguaugucugcaaacggacacugguggaccgcggguggggaaacggcuguggccuuuuugggaagggaagccuggugaccugcgcuaaauucacguguucuaagaagaugaccggcaaauccauccaacccgagaaucucgaguacagaauuaugcugagcguccaugggucucagcacuccggaaugaucguuaacgauacaggccaugaaaccgacgagaaucgggccaagguggaagugacaccuaacagcccccgcgcugaggccacccucgggggauuuggcucucugggccuggauugcgagccuagaacggggcuugacuucuccgaucuguauuaccucacaaugaauaacaaacacuggcugguccauaaggaaugguuucacgacauuccccuuccuuggcacgcgggagccgacaccggcacaccgcauuggaauaacaaagaggcucugguggaguucaaggaugcccacgcuaagcggcagaccguugugguccucgggagccaggaaggagccgugcauaccgcgcuggccggcgcucuggaagccgagauggacggggcuaaaggacgccucuuuuccggccaccugaaguguagacuuaaaauggauaagcugcggcucaaaggcguuucuuacagccugugcacagccgccuucacguuuaccaaggugcccgcugagacacuucacgggaccgucacaguggaaguccaauaugcgggaaccgacggcccuuguaaagugcccgcccagauggcuguugauaugcagacgcugacaccuguggggcgccucaucaccgccaaucccgucauuaccgaguccacagaaaacagcaagaugaugcuggagcuggacccgccuuucggagauucuuacaucgugauuggcguuggggacaagaaaaucacccaucacuggcauagauccggcagcacaaucggaaaggccuuugaagcuacggugcggggcgccaaacgcauggcgguccucggggauaccgcuugggacuucggaucuugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9083 - RNA, 1582 nt, Artificial Sequence
  KF268950.1 solE mRNA Design 3 opt
gggagaaagcuuaccaugagccagaaggugaucuaccuggucaugauucuccugaucgcccccgcuuauuccauuagaugcaucggcguuucuaaccgggacuucguggaggggaugagcggaggcaccuggguggaugucgugcuugaacacgggggauguguuacagugauggcccaagacaaaccuacggucgauauugagcuggugaccacaaccguuuccaauauggcggaagugcgcucuuacugcuaugaggcuagcaucuccgacauggccucugauagcagauguccgacacagggcgaagccuaccucgacaagcaguccgauacccaguaugucugcaaacggacacugguggaccgcggguggggaaacggcuguggccuuuuugggaagggaagccuggugaccugcgcuaaauucacguguucuaagaagaugaccggcaaauccauccaacccgagaaucucgaguacagaauuaugcugagcguccaugggucucagcacuccggaaugaucguuaacgauauuggccaugaaacagacgagaaucgggccaagguggaagugaccccuaacagcccccgcgcugaggccacacucgggggauuuggcucucugggccuggauugcgagccuagaaccgggcuugacuucuccgaucuguauuaccucacgaugaauaacaaacacuggcugguccauaaggaaugguuucacgacaucccccuuccuuggcacgcgggagccgacacaggcaccccgcauuggaauaacaaagaggcucugguggaguucaaggaugcccacgcuaagcggcagacaguugugguccucgggagccaggaaggagccgugcauaccgcgcuggccggcgcucuggaagccgagauggacggggcuaaaggacgccucuuuuccggccaccugaaguguagacuuaaaauggauaagcugcggcucaaaggcguuucuuacagccugugcaccgccgccuucacauuuacgaaggugcccgcugagacccuucacgggacagucaccguggaaguccaauaugcgggaacagacggcccuuguaaagugcccgcccagauggcuguugauaugcagacccugacgccuguggggcgccucauuacagccaaucccgucaucaccgaguccaccgaaaacagcaagaugaugcuggagcuggacccgccuuucggagauucuuacauugugaucggcguuggggacaagaaaaucacacaucacuggcauagauccggcagcaccauuggaaaggccuuugaagcuacagugcggggcgccaaacgcauggcgguccucggggauacggcuugggacuucggaucuugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9084 - RNA, 1582 nt, Artificial Sequence
  KF383116.1 solE mRNA Design 3 opt
gggagaaagcuuaccaugagccagaaggugaucuaccuggucaugauucuccugaucgcccccgcuuauuccauuagaugcaucggcguuucuaaccgggacuucguggaggggaugagcggaggcaccuggguggaugucgugcuugaacacgggggauguguuacagugauggcccaagacaaaccuacggucgauauugagcuggugaccacaaccguuuccaauauggcggaagugcgcucuuacugcuaugaggcuagcaucuccgacauggccucugauagcagauguccgacacagggcgaagccuaccucgacaagcaguccgauacccaguaugucugcaaacggacacugguggaccgcggguggggaaacggcuguggccuuuuugggaagggaagccuggugaccugcgcuaaauucacguguucuaagaagaugaccggcaaauccauccaacccgagaaucucgaguacagaauuaugcugagcguccaugggucucagcacuccggaaugaucguuaacgauauuggccaugaaacagacgagaaucgggccaagguggaagugaccccuaacagcccccgcgcugaggccacacucgggggauuuggcucucugggccuggauugcgagccuagaaccgggcuugacuucuccgaucuguauuaccucacgaugaauaacaaacacuggcugguccauaaggaaugguuucacgacaucccccuuccuuggcacgcgggagccgacacaggcaccccgcauuggaauaacaaagaggcucugguggaguucaaggaugcccacgcuaagcggcagacaguugugguccucgggagccaggaaggagccgugcauaccgcgcuggccggcgcucuggaagccgagauggacggggcuaaaggacgccucuuuuccggccaccugaaguguagacuuaaaauggauaagcugcggcucaaaggcguuucuuacagccugugcaccgccguguguacagccgcuaagguccccgcggagacgcuucacgggaccgugacagucgaagugcaauaugccggaaccgacggcccuugcaaaguucccgcucagauggccguggauaugcagacacugaccccugucgggcgccucauuacggccaaucccgugaucacagaguccaccgaaaacagcaagaugaugcuggagcuggacccgccuuucggagauucuuacauuguuaucggcgugggggacaagaaaaucacccaucacuggcauagauccggcagcacaauuggaaaggcuuuugaagccaccguccggggcgcgaaacgcauggcugugcucggggauacagccugggacuucggaucuugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9085 - RNA, 1564 nt, Artificial Sequence
  KU963574.2 solE mRNA Design 3 opt
gggagaaagcuuaccaugagccagaaggugaucuaccuggucaugauucuccugaucgcccccgcuuauuccauuagaugcaucggcguuucuaaccgggacuucguggaggggaugagcggaggcaccuggguggaugucgugcuugaacacgggggauguguuacagugauggcccaagacaaaccuacggucgauauugagcuggugaccacaaccguuuccaauauggcggaagugcgcucuuacugcuaugaggcuagcaucuccgacauggccucugauagcagauguccgacacagggcgaagccuaccucgacaagcaguccgauacccaguaugucugcaaacggacacugguggaccgcggguggggaaacggcuguggccuuuuugggaagggaagccuggugaccugcgcuaaauucacguguucuaagaagaugaccggcaaauccauccaacccgagaaucucgaguacagaauuaugcugagcguccaugggucucagcacuccggaaugaucguuaacgaugaaaaucgggccaagguggaggugacaccuaacagcccccgcgcugaagccacccugggcggguuuggaucucucggccuggacugcgagccuagaacaggccuugauuucuccgaccuguauuaccucaccaugaauaacaaacauuggcugguccacaaggagugguuucaugauauuccccuuccuuggcacagcggggcggacacggaaacaccgcacuggaauaacaaagaggcccugguggaguucaaggacgcucaugccaagcggcagaccguugugguccucggaucccaggaaggcgcugugcacacagcccuggcgggggcccuggaagcugagauggauggagccaaaggccgccucucuagcgggcaucugaaguguagacuuaaaauggacaagcugcggcucaaaggaguuuccuacagccugugcaccgcugccuuuaccuucacaaaggugcccgccgagacgcuucacggcaccgucacaguggaaguccaauaugcuggccgcgaugggccuuguaaagugcccgcgcagauggccguugacaugcagacccugacaccugugggaagacucaucaccgcuaaucccgucauuacggagucuacagaaaacuccaagaugaugcuggagcuggauccgccuuuuggcgacagcuacaucgugauugggguuggagauaagaaaaucacccaccauuggcaccggucuggcagcaucauugggaaggccuucgaagccaccgugcgcggcgcuaaaagaauggccguccucggagacacagcgugggauuuuggcuccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9086 - RNA, 1582 nt, Artificial Sequence
  KF383118.1 solE mRNA Design 3 opt
gggagaaagcuuaccaugagccagaaggugaucuaccuggucaugauuguucucaucgugcccgccuauuccauuucuugcaucggcgugagcaacagagaccuggucgaggggauguccggaggcaccuggguggauguugugcuugaacacgggggaugugucacagagauggcucaagacaaaccuacgguggauauugaacugguuaccaugacagugucuaauauggccgagguccggagcuacugcuaugaagcgucccucucugacauggcuagcgccucccgcuguccgacccagggcgagcccagccuggauaagcagucugacacacaguccgugugcaaaagaacccuuggggaucggggauggggcaacggcugugggaucuucggaaagggcagccuggugacaugcucuaaauuuaccuguugcaagaagaugccugggaaauccauccaacccgagaaucucgaauaccgcauuaugcugccuguccauggaagccagcacucuggcaugaucguuaacgacauugggcaugagacggaugaaaauagagccaagguggaggugacccccaacuccccucgggcugaggccacacugggaggcuucggcagccucgggcuggacugugaaccgcgcaccggacuugauuuuuccgaccuguauuaccucacaaugaauaacaaacacuggcugguccauaaggagugguuccacgauaucccccuuccuuggcacgcuggcgccgacaccgggacgccccauuggaauaacaaagaagcgcugguggaguuuaaggacgcccacgcuaagagacagacaguugugguccucggaucucaggaaggcgccgugcauaccgcucuggccggggcgcuggaggccgagauggauggagcuaaaggccgccucuucagcggccaccugaagugccggcuuaaaauggacaagcugagacucaaagggguuuccuauagccuguguacagccgcuuuuaccuucaccaaggugccugccgaaacacuucacggaacggucaccguggagguccaaucugccggcacagaugggcccugcaaagugccggcucagauggcgguugacaugcagacccugacaccugugggacggcucauuaccgccaaucccgucaucacggaauccacagagaacagcaagaugaugcuggaacuggauccucccuuuggcgacucuuacauugugaucgggguuggcgauaagaaaaucacccaucacuggcaucgcagcggauccaccauuggcaaggcuuucgaggccacagugagaggggccaaacggauggcuguccucggagacaccgccugggauuuuggcucuugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9087 - RNA, 1582 nt, Artificial Sequence
  KX520666.1 solE mRNA Design 3 opt
gggagaaagcuuaccaugagacagaaggugaucuaccuggucaugauucuccugaucgcccccgcuuauagcauucggugcaucggcguuuccaaccgcgacuucguggaggggaugucuggaggcaccuggguggaugucgugcuugaacacgggggauguguuacagugauggcccaagacaaaccuacggucgauauugagcuggugaccacaaccguuagcaauauggcggaagugagauccuacugcuaugaggcuucuaucagcgacauggccuccgauucucgguguccgacacagggcgaagccuaccucgacaagcagagcgauacccaguaugucugcaaacgcacacugguggacagaggguggggaaacggcuguggccuuuuugggaagggaucccuggugaccugcgcuaaauucgccuguagcaagaagaugacgggcaaaucuauccaacccgagaaucucgaguaccggauuaugcuguccguccaugggagccagcacucuggaaugaucguuaacgauaccggccaugaaacagacgagaaucgcgcuaagguggaaauuaccccuaacucccccagagccgaggcgacacucgggggauuuggcagccugggccuggauugcgagccucggaccgggcuugacuucucugaucuguauuaccucacgaugaauaacaaacacuggcuggugcauaaggaaugguuucacgacaucccccuuccuuggcacgccggagcugacacaggcaccccgcauuggaauaacaaagaggcccuggucgaguucaaggaugcucacgccaagcgccagacagugguugugcucgggucccaggaaggagcgguccauaccgcccuggcuggcgcccuggaagcugagauggacggggccaaaggaagacucagcuccggccaccugaagugucggcuuaaaauggauaagcugcgccucaaaggcgugucuuacagccugugcaccgccgcuuuuacauucacgaagauucccgcggagacccuucacgggacaguuaccguggaaguccaauaugccggaacagacggcccuuguaaagugcccgcucagauggccgucgauaugcagacccugacgccuguggggagacucaucacagccaaucccguuauuaccgaguccaccgaaaacagcaagaugaugcuggagcuggacccgccuuuuggagauucuuacaucgugaucggcgucggggaaaagaaaauuacacaucacuggcaucgguccggcagcaccaucggaaaggcuuucgaggccacagugcgcggcgcgaaaagaauggcuguucucggggacacggccugggauuuuggaucuugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9088 - RNA, 1582 nt, Artificial Sequence
  KF383120.1 solE mRNA Design 3 opt
gggagaaagcuuaccaugagccagagagugaucuaccuggucaugauucuccugaucgcccccgcuuauuccauucggugcaucggcguuucuaaccgcgacuucguggaggggaugagcggaggcaccuggguggaugucgugcuugaacacgggggauguguuacagugauggcccaagacaagccuacggucgauauugagcuggugaccacaaccguuuccaauauggcggaagugagaucuuacugcuaugaggcuagcaucuccgacauggccucugauagccgguguccgacacagggcgaagccuaccucgacaaacaguccgauacccaguaugucugcaagcgcacacugguggacagaggguggggaaacggcuguggccuuuuugggaaaggaagccuggugaccugcgcuaaguucacguguucuaaaaagaugaccggcaaguccauccaacccgagaaucucgaguaccggauuaugcugagcguccaugggucucagcacuccggaaugaucguuaacgauauuggccaugaaacagacgagaaucgcgccaaaguggaagugaccccuaacagccccagagcugaggccacacucgggggauuuggcucucugggccuggauugcgagccucggaccgggcuugacuucuccgaucuguauuaccucacgaugaauaacaagcacuggcugguccauaaagaaugguuucacgacaucccccuuccuuggcacgcgggagccgacacaggcaccccgcauuggaauaacaaggaggcucugguggaguucaaagaugcccacgcuaagcgccagacaguugugguccucgggagccaggaaggagccgugcauaccgcgcuggccggcgcucuggaagccgagauggacggggcuaagggaagacucuuuuccggccaccugaaaugucggauuaagauggauaaacuucgccugaagggcguuucuuacagccucugcaccgccgccuucacauuuuccaaagugcccgcugagacgcugcacgggaccgucacaguggaaguccaauaugcgggaagagacggcccuuguaaggugcccgcccagauggcuguugauaugcagacccuuacaccuguggggcggcugaucaccgccaaucccauuaucacggagagcacagaaaacucucgcaugaugcucgagcuggacccgccuuucggagauuccuacaucgucauuggcgugggggacaaaaagaucacccaucacuggcauagaagcggcucuaccauuggaaaggccuuugaagcuacaguucggggcgccaaaagaauggcggugcugggggauaccgcuugggacuucggaagcugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9089 - RNA, 2365 nt, Artificial Sequence
  ZIKV (strain ZikaSPH2015) Polyprotein(93-804) mRNA Design 3 opt
gggagaaagcuuaccaugaggauaauaaaugccagaaaggaaaaaaaaagaagaggagcugauacaaguguaggaauaguaggauuauuauugacaacagcaauggcagcugaaguaacgagaagagguucagcauauuauauguacuuagacaggaaugaugcaggugaagcaauaucauucccaacaacacuaggaaugaauaaauguuauauacaaauuauggaccucggacauaugugugaugcuacgaugucauaugaaugcccuaugcuggacgagggaguugaaccagaugauguugauuguuggugcaacacaacaaguacaugggucguauauggaacaugucaucauaaaaaaggagaagcacgaaggaguagaagagcuguaacauuaccaucacauucaacgcgaaagcuacaaacgcgaucacaaacaugguuagaaagcagagaauacaccaaacaucuaauuagaguagagaauuggauuuuuagaaauccaggauuugcacuggcggccgcugcaauugcauggcuauuaggaaguucaaccagucaaaaaguaauauaccuaguaaugauauuacuaauagcgccagcuuauagcauaagaugcauaggaguuaguaaccgagauuuugucgagggaaugucaggugguacuuggguagacauagugcuagaacaugguggauguguaacaguuauggcacaggacaaaccaacaguagacauugaacucguaacaacaacuguaaguaauauggcagaaguacggucauacuguuaugaagcuaguauaucagauauggcaagcgacagcagaugcccaacucaaggggaagcauacuuagauaaacaaagugauacucaguauguauguaaacgaacauuaguagacagaggauggggaaacggauguggacuuuucgguaaagguagccuagugacaugugcaaaauuugcuuguaguaaaaaaaugacuggaaaaucaauacaacccgaaaaucuagaauauagaauaauguugucaguccacggaucacagcauucugguaugauuguaaaugauacuggacaugaaacagaugaaaauagagcaaaaguagaaauaacaccaaacaguccaagggcagaagcaacauuaggugguuuuggaucacuaggguuagauugugaaccaaggacgggauuagauuuuagcgacuuauacuauuuaaccaugaacaauaaacacugguuaguacacaaagaaugguuucacgauauaccguugccguggcaugcgggagcugauacaggcacaccacauuggaauaauaaagaagcccuaguagaauucaaagacgcacacgcgaaaagacaaacaguaguaguauuagguucgcaagaaggcgcagugcauaccgcauuggcaggugcauuggaagcagaaauggauggagcaaaaggaagguuaaguucuggacauuugaaauguagauugaaaauggauaaacuaagacuaaaaggagugagcuauucauuauguaccgcagcauuuacauucacaaaaauuccagcagaaacguuacacggaacaguuacgguagaaguacaauaugcagggacagauggccccuguaaaguaccagcucaaauggcgguugauaugcaaacccuaaccccagugggaagauuaauuacagcuaacccaguaauaacagaaaguaccgaaaauagcaaaaugaugcuugaacuagacccaccauuuggagauucauacauaguaauaggaguuggagaaaaaaagauaacacaucauuggcauaggaguggaaguacuaucggaaaagcguuugaagcgacaguuagaggagcaaaaagaauggcuguguuaggggauacagcaugggauuuuggaagcgucggaggagccuuaaauucuuuaggaaaaggaauucaucaaauauuuggggccgcauucaaaagucuauuugguggaaugucaugguuuucacaaauauuaauaggaacauuguuaauguggcuaggauuaaacacuaaaaacggaagcauaucacuaaugugucuagcuuuggguggaguacuaauauuucuauccacugcuguaucagcagacgugggguguagcguggacuucaguaaaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9090 - RNA, 2365 nt, Artificial Sequence
  ZIKV (isolate Z1106033) Polyprotein(93-804) mRNA Design 3 opt
gggagaaagcuuaccaugagaauaaucaaugcgaggaaagaaaagaaaagaagaggagccgacacuagcgucgguauaguagguuuauuauuaacaacugccauggccgccgaaguuacaagaagagguucagcauacuacauguauuuagauagaaaugaugcaggagaagcuauuuccuuuccuacaacucuuggaaugaauaaauguuauauccaaauuauggaucuaggacauacgugcgaugcaacaaugagcuacgaauguccaauguuagaugaaggaguagaaccagaugacguugauugcugguguaacacaacuucaacauggguaguuuauggcacaugucaucauaagaaaggagaagcaagaagaaguagacgugcaguaacauuaccaagucauucaacuagaaaacuacaaacuaggagccaaacauggcuugaaaguagagaguauacaaaacaccuuauuagaguagaaaauuggauauuuaggaauccaggauucgcguuagcagcagcugcaauagcaugguugcuaggaagcucaacaagucaaaaaguaauauauuuaguaaugauacuucuaauagcaccagcauauucaauaagauguaucggaguaucaaaccgagauuuugucgaaggaaugucuggugguacauggguagacguaguauuagagcacggaggauguguaacaguaauggcacaagauaaaccaacaguggauauagaauuggucacaacaaccguaucaaauauggcugaagucagaagcuacugcuaugaagcaucgauaagugauauggcgagugacucuagaugcccaacccaaggagaagcauacuuagauaaacaaucagacacacaauacguauguaaaagaacuuuaguagauagagguuggggcaacggauguggacucuuuggaaaaggaucgcuaguuacaugugcaaaauuugccuguucaaagaaaaugacgggaaaaucaauacagccagaaaauuuagaauauagaauaauguugaguguacauggaucccaacauucaggaaugauaguaaaugauacaggacaugaaacugacgaaaauagagcaaaaguugaaauaacaccaaauucaccacgugcagaggcgacacucggugguuucgggucauugggucuugauugugaaccaagaacaggauuagauuuuucagauuuauauuacuuaacaaugaacaauaaacacugguuaguacauaaagaaugguuucaugauauaccguuaccauggcaugcaggagcagauacaggcacaccacauuggaauaauaaagaagcauuaguugaguucaaagaugcgcacgcuaaaagacaaacaguugucguauuagguagucaagaaggagcaguacauacagcgcuagcuggagcacuagaagcugaaauggauggagcaaaaggaagacuaaguaguggucauuuaaaauguagauuaaaaauggacaaacuuagguuaaaaggaguuaguuacucauuauguacugcggcuuuuacauuuacaaaaauaccugcagaaacauuacacgguacaguuacagucgaaguacaauaugcugguacagacggaccuuguaaaguaccagcucaaauggcaguagauaugcaaacacuaacaccaguuggacgccuaauaaccgcaaauccuguuauaacagaaucuacggaaaacucaaaaaugauguuagaauuagaucccccauuuggggauucauauauaguaauugggguaggagaaaagaaaauaacacaucacuggcacagaaguggaaguacaauaggaaaagcauucgaagcaacaguaagaggagcaaaaagaauggcaguccuaggggacacugcaugggauuucggaagcguaggaggggcuuuaaauagucucgggaaaggaauccaucaaaucuuuggagcagcguuuaaaucacuauuuggaggaaugucaugguuuucacaaauauuaauagguacuuuacuaaugugguuaggacuaaaugcuaaaaacggcucaauuucauuaauguguuuagcauuaggaggaguuuugauauucuuaucaacagcaguuagcgcugacguuggauguaguguagauuuuagcaaaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9091 - RNA, 2353 nt, Artificial Sequence
  ZIKV (strain MR 766) Polyprotein(93-800) mRNA Design 3 opt
gggagaaagcuuaccaugcgaauaauaaacgcgagaaaagaacguaaacgucgaggagcagacacaagcauaggcauaauaggauuacugcuaacaaccgcaauggcagccgaaauaacaagaagaggaucagccuauuauauguaucuagauagaagugaugcagguaaagccauaucauuugcaaccacguuaggaguaaauaaaugccauguacaaauaauggaccuuggacauaugugcgaugcaacaaugucuuaugaauguccuaugcuagaugaaggaguagaaccagaugacguugauuguugguguaauacaacuuccacauggguagucuacggaacaugccaucacaaaaaaggugaagcuaggaggucaagacgagccguaacauuaccaucucauucaacaagaaaauuacaaacaagaucacaaacauggcuagaaucaagggaauauacaaaacaucuuauaaaaguagaaaauuggauuuucagaaauccugguuuugcacuaguagcaguagcaauagccuggcucuuagguagcaguaccagccaaaaaguaauauaucucgucaugauucuauuaauagcuccagccuacagcauaagauguauuggaguaucaaauagagauuuuguagaagguaugucuggaggaacauggguugauguaguuuuagaacaugggggauguguaacaguaauggcacaagauaaaccaacaguggacauugaauuagucaccacaacuguaucuaauauggcagagguacgaucauauuguuaugaagcaagcauaagcgauauggcgagugauucaagaugccccacacaaggagaagcuuauuuagauaaacaaagugauacacaguauguaugcaaaagaacccuaguggauagagguugggguaaugguugcggauuauuuggaaaaggaagucuaguaacaugugcaaaauucacuuguucaaaaaaaaugacagggaaaaguauacaaccagaaaauuuagaauauagaauaauguuaagcguacaugguucacaacauucgggaaugauaggauaugaaacagaugaagauagggccaaaguagaaguaacaccaaacaguccaagagcagaagccacacuuggugguuucggaucucucggauuagacugugaaccucgaacagggcuugacuuuucagaucuauacuauuuaacaaugaauaauaagcauuggcuaguucacaaagaaugguuucacgauauuccgcuuccauggcaugcgggagcagauacaggaacuccacauuggaauaauaaagaagcacuaguugaauucaaagaugcacaugcaaaaagacaaacagucguaguuuuaggaucacaagaaggagcaguacauacagcacuagccggagcuuuagaagcagaaauggauggugcaaaaggacgacuauuuagcggacaccuaaaaugucgucuaaaaauggauaaacuuagauuaaaaggaguaucguacucguuauguacagcagcauuuacauuuacuaaagugcccgcagaaacacuacauggaacagugacuguugaaguacaauaugcaggaacagauggcccauguaaaauuccuguucaaauggcaguugauaugcaaacauuaacuccaguuggaagacuaauaacagcaaacccuguuauaacagaaucaacugaaaauaguaaaaugauguuggaacuggacccaccauucggagauaguuacauaguaauagguguaggagauaagaaaauaacacaucauuggcacagaucagguaguaccauugguaaagcauucgaagcaacaguuagaggagcaaaaagaauggcaguucucggagauacagcaugggauuuugguagugugggagguguuuuuaacaguuuagguaaaggaauacaucaaaucuuuggugcagcuuuuaaaagccuauuuggaggaaugucaugguucucucaaauucuaauagguacacuauuaguuuggcuaggacuuaauacgaaaaaugggucuauuaguuuaacuuguuuagcacucggaggaguaaugauauucuuaaguacagcaguauccgcugacgucgguuguucaguagauuucucaaaaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9092 - RNA, 2365 nt, Artificial Sequence
  ZIKV (strain NatalRGN) Polyprotein(93-804) mRNA Design 3 opt
gggagaaagcuuaccaugagaauaauaaaugcaaggaaagaaaagaaaagaagaggagcagacacaagcguagguauaguaggguuauuauuaacaacugcuauggcugcugaaguaacaaggagggguagugcauauuauauguauuuagacagaaacgaugcaggggaagcaauaaguuuuccuacaacauuaggaaugaauaaauguuauauccaaauuauggacuuaggccauaugugugacgcuacaaugaguuacgaauguccaauguuagaugaagguguagaaccagacgauguggauuguugguguaacacaacaucaacauggguaguauaugguacaugucaucauaagaaaggagaagcaagaagaucaaggagagcuguaacucuaccuucacacagcacaagaaaauuacaaacuagaucacagaccugguuagaaucuagagaauauacaaaacauuuaaucagaguagaaaauuggaucuucagaaaccccggguuugcucucgcagcagcagcaauagcaugguuacuuggaaguucuacaucacaaaaaguuauuuaccuaguaaugauucuacuaauagcaccagcuuauagcauaagaugcauuggaguuaguaacagagacuuuguagaaggaaugucaggugguacuugggucgaugugguauuagaacaugggggaugcguaacuguuauggcacaagacaaaccaacaguagauaucgagcuaguaacaacaacgguaagcaacauggcagaagugagaaguuauuguuaugaagcaagcauaagugauauggcauccgauucacgauguccaacacaaggugaagcauaccuagauaaacaaucagauacacaauauguauguaaaagaacauuaguugauagggguuggggaaauggauguggacuauucggaaaagggucauuagugacgugugcaaaauuugccugcaguaagaaaaugacugggaaaagcauucaaccagaaaaucuagaauauagaauaaugcuaaguguacauggaucucaacauaguggcaugauaguaaacgauacaggacacgaaacugacgaaaacagagcuaaaguagaaaucacucccaauagcccaagagcugaagcaacacuaggaggauuuggaucauuaggacuugacugugaaccuagaacaggauuggacuuuagcgaucuauacuaucuaacaaugaauaauaaacauuggcuaguacauaaagaaugguuucaugauauuccacuuccauggcacgccggcgcagacacagggaccccucacuggaacaauaaagaagcauuaguagaguucaaagaugcucaugcaaaaagacaaacaguaguuguauuagguucgcaagaaggagccguacauacugcacuugcaggagcuuuagaagcagaaauggauggagcaaaaggacgauuaucuaguggacaucuaaaauguagacuaaaaauggacaaauuaagauuaaaaggaguaagcuauucauuauguacagcagcauuuacauucacaaaaauaccugcugaaacccuacacggcacaguaacaguagaaguucaauaugcaggaacugauggaccuugcaaaguacccgcacaaauggcaguugauaugcaaaccuuaaccccuguuggcagacuaaucacagcaaacccaguuauaacagaaucaacagaaaauagcaaaaugaugcuagaacuggauccaccuuucggugauucauauauaguaauaggaguaggggaaaagaaaauuacucaucacuggcauagaucaggaucaacaaucgguaaagcauucgaagcuacaguacgaggggcaaaaagaauggcaguacuaggagauacugcaugggauuuugguaguguagguggagcacuaaauuccuugggaaaaggaauacaccaaauauuuggagcugcauuuaaaagucuauuuggaggaaugagcugguuuagccagauucuaauuggaacauuacuuauguggcucggauuaaacacaaagaauggaaguauuucauuaauguguuuagcucucgguggcguauuaauauuuuuaaguacagcaguuagcgcagacguuggauguucaguagauuuuaguaaaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9093 - RNA, 2290 nt, Artificial Sequence
  ZIKV (strain ZikaSPH2015) Polyprotein(108-794) mRNA Design 3 opt
gggagaaagcuuaccaugacaagcguaggaauuguuggacuauugcuaacaacugcaauggcugcagagguaacucgaagaggcagcgcauacuacauguauuuggauagaaaugacgcaggggaagcaauaagcuuuccaacgacauuaggaaugaauaaauguuauauacaaauaauggauuuaggacacaugugugaugcaacuaugaguuaugagugcccaaugcuugaugaaggagucgaaccagaugauguugauuguugguguaauaccacaaguacauggguugucuacggaacaugucaccauaaaaaaggugaagcuagaagaaguagaagagcaguaacacuacccagucacucaacuagaaaacuacaaaccagaucccaaacaugguuagaaaguagggaauacacaaaacaucuaauuagaguugaaaacuggauauuuagaaauccagguuucgcuuuagcagcagcagcaauugcuugguuauuaggaaguucaacaucacagaaaguuauauaccuaguaaugauacuacuaauugcacccgcauauaguauacgauguauuggaguuagcaaucgugauuucguugaaggaaugucaggaggaacuuggguugacauaguauuagaacauggaggguguguaacgguuauggcacaagauaaaccaacgguugauauagagcuaguaacaacaacaguuagcaauauggcagaaguacgaucauauugcuaugaagcuucaauaucagauauggcaucagauucgagauguccaacacaaggggaagcauauuuagauaaacaaagugauacacaauauguauguaaacgaacacuaguagauagagguugggggaauggaugugguuuauucggaaaaggaucacuuguaacaugugcaaaguuugcauguucaaaaaaaaugacaggcaaaagcauacaaccagaaaaucuagaauacagaaucauguuaucaguacauggaucucaacauagcggaaugauaguuaaugacacaggacaugaaacagaugaaaauagagcgaaaguagagauaacaccuaauaguccaagagcagaagcaacauugggaggauucggaucucuaggacuagauugugaaccacgaacaggacuugacuuuucugauuuauacuaucuaacaaugaacaauaaacacuggcuaguacauaaagaaugguuucacgauauaccacuaccauggcacgccggagcagauaccggaacaccacauuggaauaauaaagaagcauuaguagaauuuaaagaugcccaugcuaaaagacaaacaguuguagugcuuggaagucaagaaggagcaguacauacagcauuggcuggugcauuagaagcagaaauggauggugcaaaaggaaggcuaaguucuggacaucuaaaauguaggcuaaaaauggauaaauuaagauuaaaaggaguaucauauucauuauguaccgcugccuucacuuuuacaaaaauaccagcagaaacgcugcacggaacuguaacaguugaaguacaauaugcuggaacagauggaccaugcaaaguuccugcacaaauggcuguagacaugcaaacacugacuccuguugggagacuaauuacagcaaaccccguaauaacagaaaguaccgaaaacucuaaaaugauguuagaauuagauccaccuuucggggauaguuauauaguaauaggaguaggggaaaaaaaaauaacucaucacuggcauaggagcggcaguacuauagguaaagccuuugaagcaacugucagaggugcaaaaagaauggcaguguuaggugacacagcaugggauuucggaucaguaggaggugcauuaaauaguuuaggcaaaggcauucaucaaauauuuggggccgcauucaaaagucuguucggaggaaugagcugguucagucagauauuaauaggaacacuauuaauguggcuaggucuaaacacaaaaaacgggaguauuagucucaugugucuugcauuaggaggaguauuaauauuuuuaaguacagcagucucagcaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9094 - RNA, 2290 nt, Artificial Sequence
  ZIKV (isolate Z1106033) Polyprotein(108-794) mRNA Design 3 opt
gggagaaagcuuaccaugaccucaguagguauaguagguuuacuauuaacaaccgcaauggcagcagaagugacaagaagaggaucagcauacuauauguauuuagauagaaaugaugcaggagaggcaauuucauucccaacaaccuuaggaaugaacaaauguuauauacaaauaauggauuuaggacauacaugugacgcaacaaugaguuacgaauguccaaugcuagacgaagguguagaaccagaugacguagacugcugguguaauacaacaucaacauggguuguuuacggaaccugucaucauaagaaaggugaagcaagaagaaguagacgagccguaacucuaccaucacacucaaccagaaaacuccaaacaagaagucagacauggcuugaaagccgagaauacacuaaacauuuaauaagaguugaaaauuggauuuuuagaaacccaggauucgcauuagcagcagcagcaauagcgugguuacuagguucaucaacgucacaaaaaguuauuuauuuagucaugauucuguuaauagcaccagcuuacaguauaagauguaucggaguaucaaauagggacuuuguugaaggaauguccggagguacuuggguagauguaguauuagaacauggaggauguguaacaguaauggcacaagacaaaccaaccguagauauagagcuaguaacuacuacaguauccaauauggcagaaguacguaguuauuguuaugaagccagcauaagugauauggcaucagauucaagaugcccaacacaaggugaagcauauuuagauaaacaaagugacacacaauacguauguaaaagaacauuaguagacagaggauggggaaaugguuguggauuauucgggaagggaucacuuguaacuugugccaaauucgcaugcucaaagaaaaugacagggaaaucgauacaaccagaaaauuuagaauacagaauaaugcucaguguacauggaagccaacauucaggaaugaucguuaaugauacuggucaugaaacagacgaaaacagagccaaaguugaaauaacaccuaauucaccaagagcugaagcaacauuaggaggauucggaucauuaggucuagacugugaaccaagaacaggucuagacuuuagcgauuuauauuaccuaacuaugaauaauaaacauuggcuaguucauaaagaaugguuucaugauauaccacucccuuggcaugcaggagcagacacaggaacaccacauuggaauaauaaagaagccuuaguagaauuuaaagaugcacaugcuaaaagacagacaguuguuguacucggaucucaagaaggagcaguacauacagcauuagcaggagcauuagaagcagaaauggauggugcaaaagguagauuaucuaguggucaccuuaaaugucgauuaaaaauggauaaauuaagauuaaaagggguuucauauagucuuugcacugcugcguuuacauuuacuaaaauaccagcagaaacucuacacggcacaguaacuguagaaguacaauaugcuggaacugacggccccuguaaaguaccagcgcaaauggcugucgauaugcaaacccuaacacccguaggaaggcugauaacagcaaauccuguaauaacagaaaguacggaaaauucaaaaaugauguuagaacuagauccaccauucggcgauucauacauaguaauuggaguaggagaaaagaaaauaacccaccauuggcauaggagcggaagcacaauaggaaaagcauucgaagcaacaguaagaggugcaaaaagaauggcaguacuaggagauacagcuugggacuuuggauccguugguggagcauuaaauucguuagguaaaggaauacaccaaauuuucggagcagcuuucaaaucccuauuuggaggaaugucaugguuuucccaaaucuuaauaggaacacuauuaauguggcuaggccuaaaugcuaaaaauggaucuauaucauuaaugugcuuagcacuaggcggcguucugauauuuuuaagcacugcaguaucagcaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9095 - RNA, 2278 nt, Artificial Sequence
  ZIKV (strain MR 766) Polyprotein(108-790) mRNA Design 3 opt
gggagaaagcuuaccaugacaaguauaggaaucauuggauuacuacuaacaacugcaauggcagcagaaauaacuagacgaggaucagcauauuacauguauuuagauagauccgaugcuggcaaagcaauuucauuugcaacaacacuaggaguaaacaaaugucauguucaaauaauggaucuaggacauaugugugaugccacaaugucguaugaguguccaauguuagaugaagguguagaaccagacgauguagauugcugguguaauacgacauccacauggguaguauauggaacuugucaucacaagaaaggagaggcaagacgcuccaggagagcaguuacauuaccaagucauaguacaagaaaauuacaaacaagaagccaaacuuggcuugaaucgagagaauauacaaaacauuuaauuaaaguagaaaauuggauauuuagaaacccaggauucgcauuaguggcagucgcaauugccuggcuauuagggagcaguacaucacaaaaaguaauauaucucguaaugauacuauuaauagcuccugcauacagcauaagaugcauaggaguuucaaaccgagauuuuguagaagguaugagcggaggcacauggguagacguuguacuagaacauggaggaugugucacugugauggcacaagacaaaccaacaguagauaucgaacugguaacaacaacaguaaguaauauggcagaaguaagauccuauugcuaugaagcaucgauaucagacauggcaagugauucuagaugcccaacucaaggagaagcauauuuagauaaacaaagcgacacacaauauguaugcaagaggacucuaguagauagagguugggguaauggauguggcuuauuuggaaaaggaagucucguaacaugcgcaaaguucacauguucaaagaaaaugacuggaaaaucuauacaaccagaaaauuuagaguauagaauaaugcucagcguacaugguucacaacacaguggaaugaucggauacgaaacugacgaagaccgagcaaaaguugaaguaaccccuaauucaccaagagcagaagcaacauuaggaggguucggaagccucggauuagacugcgaaccacgaacaggauuagauuuuucagaucuauacuauuuaacaaugaacaacaaacauugguuaguucauaaagaaugguuucaugauauaccacuaccauggcaugcaggcgcugauacaggcacuccacauuggaauaacaaagaagcauuaguagaauuuaaagacgcacacgcaaaacgacaaacaguaguaguuuuaggaagccaagaaggagcgguacacacugcauuagccggugcauuagaagcagaaauggauggugcaaaaggaagacuauuuucuggucauuuaaaaugucgauuaaaaauggauaaauuaagacucaaaggaguaucuuacaguuuauguacagcagcauucacauucacaaaaguaccugcagaaacauuacauggaacgguuacaguagaagugcaauaugcuggaacagauggaccauguaaaauaccagugcaaauggcuguagauaugcagacuuuaacaccagucggaagauuaauaaccgcaaauccaguaauaacagaaaguaccgaaaauucaaaaaugauguuagaauuagauccaccauuuggcgacaguuauauuguuauaggaguaggcgauaagaaaauaacacaucacuggcauagaagcggaucuacaauaggaaaagccuuugaagcaacaguaagaggagccaaaagaauggcaguacucggugauacagcuugggauuucggaucuguuggaggaguuuucaauucauuaggcaaaggaauacaucaaauauucggagcugccuuuaaaucauuauuugguggaaugucaugguuuucucaaauucuaauagguacauuacuuguauggcuaggacuaaacacuaaaaaugguucaauaucacuaacaugucuagcuuuaggcggaguaaugaucuucuuaagcacagcuguaucagcaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9096 - RNA, 2290 nt, Artificial Sequence
  ZIKV (strain NatalRGN) Polyprotein(108-794) mRNA Design 3 opt
gggagaaagcuuaccaugacaucaguaggaauagucggacuuuuguuaacgacagccauggcagcugaaguaacaagaagaggcucugcauacuauauguaucuagaccggaacgacgccggagaagcaauaucauucccaacaacauuaggcaugaauaaaugcuacauacaaauuauggaucuuggacauaugugcgaugcaacaaugucuuaugaauguccaauguuggaugaaggaguugaaccugacgauguagacugcuggugcaacacaacaucaacauggguuguauaugguaccugucaucauaaaaaaggcgaagccagaagaucaagaagggcaguaacacugccuagucauaguacuagaaaauuacaaacuagaucacaaacuugguuagaaucaagggaauacacaaaacaccuaauacgaguagaaaauuggauauuucgaaauccaggguucgcacuagcagcagcugcaauagcauggcuuuuaggaaguucaacaagccaaaaagucauauaucuaguuaugauucuacuuauagcaccugcauacucaauacgaugcauaggagucucaaauagggauuuuguagaagguaugucaggagggaccuggguagacguaguacuagaacaugguggauguguaacagucauggcacaagauaaaccaacaguagacauagaauuaguaacaacgacugucuccaauauggccgaaguuagaucauacugcuacgaagcuucuauaucagauauggcaagcgauucaagaugucccacccaaggugaagcauaucuagacaaacaaucagauacacaauacguuuguaaaagaacauuaguagacagagguuggggaaauggauguggauuauuuggaaaagguaguuuaguaacaugcgcaaaauuugcuugcagcaaaaaaaugacaggaaaauccauacaaccagaaaaccuugaguauagaauaaugcucaguguucauggaucacaacauucuggaaugauaguaaaugacacaggacacgaaacugacgagaaucgugcuaaaguagaaauaaccccaaauaguccuagagcagaagcaacauuaggcggauuuggaaguuuaggauuagauugugaaccaagaacaggcuuggauuuuagugaucuauauuacuuaacaaugaauaacaaacauugguugguccauaaagaaugguuccaugauauaccauuaccauggcacgcuggagcagauacuggaacaccgcauuggaauaauaaagaagcacuuguugaauucaaagacgcucaugcuaaacgacaaacaguaguuguacucggaagccaagaaggcgcaguccacacagcucuagcaggagcguuagaagcugaaauggauggcgcaaagggaagauuaagcucaggacaccuaaaaugcagacuuaaaauggacaaacuaagauuaaaaggaguuaguuauagccuauguacagcagcauucacauuuacuaaaauaccagcugaaacauuacauggaacuguuacaguagaaguacaauaugcaggaacagaugguccauguaaaguaccugcacaaauggcaguagauaugcaaacauuaacaccugucggaagauuaauuacagcaaauccuguaauaacggaaaguaccgaaaauucaaaaaugaugcuagaauuagacccaccuuuuggcgauagcuacauaguaauuggaguaggagaaaaaaaaauaacacaucauuggcaccgaaguggaagcacaauaggaaaagcauuugaagcaacaguuagaggagcaaaaagaauggcaguauuaggggauaccgccugggauuucgguucuguaggaggugcacuaaauagucuuggaaaaggcauacaccaaauuuuuggagcagcuuucaaaucacuguuugguggaaugaguugguuuucacaaauucuaauaggaacauuauuaaugugguuaggauuaaauacaaaaaacggaucaauaagcuuaaugugucuagccuuaggaggcguauuaauauuccuaucgacagccguaagugcaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9097 - RNA, 1582 nt, Artificial Sequence
  ZIKV (strain ZikaSPH2015) Polyprotein(273-723) mRNA Design 3 opt
gggagaaagcuuaccaugagucaaaaaguaauauaucuagucaugauauuauuaauagcaccagcauauucaauaagauguauaggagucucaaacagggauuucguagaaggaaugaguggagguacguggguagauauaguuuuagaacauggaggauguguaaccguuauggcacaagacaaaccaacaguagacauagaguuagucacaacaacaguaagcaauauggcagaaguaagaucauacuguuaugaagcaaguauaagugauauggcaagugacucaagauguccaacucagggagaagcauaccuagacaaacaaucagacacacaauacguauguaaacgaacacuaguggauagaggauggggaaaugguuguggacuauuuggaaaaggaagccugguuacaugcgcuaaauuugccugcucaaaaaaaaugacaggaaaaucaauacaaccagaaaaucuagaauaucggauuauguuaagcguacauggaagccaacacucaggaaugauaguaaaugauacaggacaugaaacagaugaaaaucgagcaaaaguggaaauaaccccaaacagcccaagagcagaagcuacacuaggaggauuuggauccuuaggacuagauugugaacccagaacaggacuagacuuuucugauuuauacuaucuuacaaugaauaauaaacauugguuaguacacaaagaaugguuccaugauauaccauuaccauggcaugcaggagcagauacgggcacaccacacuggaauaauaaagaagcauuaguagaauuuaaagaugcacacgcaaaaagacaaacaguaguaguauuaggaucacaagaaggcgcaguucauacagcccuagcaggagcacuagaagcagaaauggauggagcaaaaggaaggcuuagcagcggucauuuaaaaugcagauuaaaaauggauaaauuaagacuaaaaggaguaaguuauagucuauguacagccgcauuuacauuuacaaaaauaccagccgaaacuuuacauggaacaguaacaguagagguacaauaugcaggaacggacggaccauguaaaguaccagcacaaauggcuguagacaugcaaacacuaaccccaguaggcagauuaauaacagcuaauccaguuauaacagaaaguacagaaaauucuaaaaugaugcuagaauuagacccaccuuuuggagacucauauauaguaauagguguaggagaaaaaaaaauaacacaucauuggcauagaucaggaaguacaauaggaaaagcauucgaagcaaccguaagaggagccaaaagaauggcgguacuaggugauacagcaugggauuuuggcucaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9098 - RNA, 1582 nt, Artificial Sequence
  ZIKV (isolate Z1106033) Polyprotein(273-723) mRNA Design 3 opt
gggagaaagcuuaccaugagucaaaaaguuauauauuuaguuaugauuuuacuuauagcuccggcauacaguauaagauguauaggaguaucaaauagagauuucguagagggaaugaguggaggaacauggguagauguaguauuagaacauggagguuguguaacaguaauggcacaagacaaaccaacaguagauauagaauuaguuacaaccacaguaucaaauauggcagaaguaagaagcuauugcuaugaagcaaguauaagugacauggcaagugauagcagauguccaacacaaggagaagcauauuuagauaaacaaagugauacacaauacguuuguaaaagaacauuaguagauagagguuggggaaacggaugugguuuauuuggaaaagggucuuuaguaacuugugcgaaauuugcuugcaguaaaaaaaugacaggaaaaucaauacaaccagaaaauuuagaauauaggauaauguuaucaguacauggaucucaacauagcgguaugauaguaaaugacacaggacaugaaacagaugaaaauagagcaaaaguagaaauaacaccgaauucgcccagagcagaagcaacacugggaggauuuggaagccuaggacuagauugugaaccaagaacgggacuagauuuuucagaucuguauuaucuuacaaugaauaauaaacauuggcuagugcauaaagagugguuucaugauauaccacuaccauggcaugcaggagcagacacagguacaccacauuggaauaauaaagaagcacuaguagaauucaaagacgcacaugcaaaaagacaaacaguuguuguacuaggaagccaagaaggagcaguacauacagcauuagcaggggcauuagaagcagaaauggacggagcaaaagguagacuaucgagcggacaccuaaaauguagauuaaaaauggauaaacuacgauuaaaaggaguaaguuacaguuuaugcacagcugcauuuacauuuacaaaaauaccggcagaaacauuacauggaacgguuacaguagaaguacaauacgcuggaacagauggacccuguaaagugccugcgcaaauggcaguggacaugcaaacauugacaccaguaggaagacuaauaacagcaaauccaguaauaacagaaaguacggaaaauaguaaaaugauguuagaacuagauccuccauuuggagacucauauauaguaauaggaguaggagaaaaaaaaaucacacaccacuggcacagaucaggaucgacaauaggaaaagccuuugaagcaacaguaagaggagcaaaaagaauggcuguauuaggggacacagcaugggacuuuggaaguugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9099 - RNA, 1570 nt, Artificial Sequence
  ZIKV (strain MR 766) Polyprotein(273-719) mRNA Design 3 opt
gggagaaagcuuaccaugucacaaaaaguaauuuaucuaguuaugauauuauuaauagcuccagcauacaguauaagauguauaggaguaucaaacagagacuuuguagaaggaaugucaggaggaacauggguugacguaguauuagaacacgguggaugcguaacaguaauggcacaggacaaaccaacaguugauauagaauuaguuacaacaacaguuucaaauauggcugaaguaagaucauauuguuaugaagcaaguauaagugacauggccagcgacaguagaugcccuacacaaggagaagcauaccuagauaaacaaagcgauacacaauacgucugcaaaagaacccuaguagacagagguuggggcaacgguuguggacuauuugguaaagguagcuugguaacaugugcaaaauuuacauguucaaagaaaaugacaggaaaaucaauacaacccgaaaaucuugaauauagaauaaugcugaguguacauggaagucaacauucaggaaugaucggauacgaaacagacgaagauagagcaaaaguagaaguaacaccaaauucaccgagagcagaagcaacacuaggaggauuuggcucacuaggauuagacugugaaccaagaacaggacuagauuucagugaucuauacuaccuaacaaugaacaacaaacacugguuaguacauaaagaaugguuucaugacauaccauuaccuuggcacgcaggagcagauacaggaacaccacauuggaauaauaaagaagcauuaguggaauuuaaagaugcucaugcaaaaagacaaacaguaguaguacuaggaagucaagaaggcgccguacacacagcucuagcaggagcauuagaagcagaaauggauggagcaaaaggaagauuauuuaguggacacuuaaaauguagauuaaaaauggauaaacuaagauuaaaagguguaucauauaguuuauguacagcagcuuucacauuuacaaaaguaccagcagaaacauuacauggaacagucacaguagaaguacaauacgcaggaacagauggaccauguaaaauaccaguacaaauggcaguagacaugcaaacacuaacuccaguaggaagguuaauaacagcaaauccaguaauaacagaaaguacagaaaauaguaaaaugauguuagaauuagaucccccauuuggagacaguuauauagugauaggcguaggagacaagaaaauaacacaucauuggcauagaucagguucaacuauaggaaaagcauuugaagcuacaguaagaggugcgaaaagaauggcaguacuaggagauacagcaugggacuuuggaaguugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9100 - RNA, 1582 nt, Artificial Sequence
  ZIKV (strain NatalRGN) Polyprotein(273-723) mRNA Design 3 opt
gggagaaagcuuaccaugagucaaaaaguuauauauuugguaaugauauuacuaauugcuccagcauauucaauacgaugcauaggaguaucaaauagagauuucgucgaaggaaugaguggaggaacauggguagauguaguauuagaacauggaggaugcguaacaguaauggcacaagauaaaccaacaguagauauagaacuaguaacaacaaccguaucaaacauggcagaaguaagaucauauuguuaugaagcaucaauaagcgacauggcgucugauaguagaugcccaacacaaggugaggcauauuuagauaaacaaagcgauacacaauauguuugcaaaagaacauuagucgauagaggauggggaaauggauguggauuguucggaaaaggaucacuagucacaugugcaaaguuugcauguaguaaaaaaaugacaggaaaaaguauccaaccagaaaacuuagaauauagaauaaugcucaguguacaugguagucaacauaguggcaugauagugaaugauacaggucaugaaacagaugaaaaucgagcgaaaguagaaauuacacccaauucuccuagagcagaagcaacuuuaggaggauuuggaaguuuaggauuagauugcgaaccaagaacaggauuagacuucagcgaucuauacuauuuaacaaugaacaauaaacauuggcucguacauaaagaaugguuucaugacauaccucuaccuuggcacgcaggagcagauacaggaacuccacauuggaauaauaaagaagccuuaguagaauuuaaagaugcacaugcaaaaagacaaacaguagucguacuaggaagccaagaaggagcaguacauacugcauuggcaggagcauuagaagcagaaauggacggugcaaaaggaagguuaucaaguggacaucuaaaaugcagacuuaaaauggauaaauuaagauuaaaaggaguaaguuauucauuaugcacagcagcauuuacauuuacaaaaaucccagcagaaacacuacauggaacaguaacaguagaaguacaauacgcaggaacugauggaccauguaaaguaccagcacaaauggccguugauaugcaaacauuaacaccaguaggaagauuaauaacagcaaauccaguaauaacagaaaguaccgaaaacaguaaaaugauguuagaacuagauccuccauuuggagacaguuacauaguuauaggaguaggagaaaaaaaaauaacacaccauuggcacagaaguggaagcacaauagguaaagcauuugaagcaacaguaaggggagcaaaaagaauggcaguacuaggagauacagcaugggauuucggaucaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9101 - RNA, 2290 nt, Artificial Sequence
  ZIKV (strain ZikaSPH2015) Polyprotein(108-794)(F398S) mRNA Design 3 opt
gggagaaagcuuaccaugacaucaguaggaauuguuggauuauuacuaacaacagcaauggcagcagaaguaacaagacgaggaagcgcauauuauauguaucuggauagaaaugaugcuggugaagcaauaaguuuuccaacaaccuuagguaugaauaaauguuacauucaaaucauggauuuaggacacaugugugaugcaacaaugucauaugaauguccuaugcuagaugaaggcguugaaccagacgauguggauuguuggugcaacacaacaaguacaugggugguauaugguacgugucaucacaagaaaggagaagcaagaagaucaaggagagcaguuacacuuccaagccauaguacaagaaaauuacaaacaagaagucaaacaugguuagaaucaagagaguacacaaaacaccuaauuagaguagaaaauuggauauucagaaauccaggguucgcacucgcagcagcagcuauagcaugguuacuaggaaguaguacaagucaaaaaguaauauaucuaguaaugauacuauugaucgcgccagcauauucuauaagauguauaggaguaagcaauagagauuuuguagaagguaugucuggagguacauggguagauauaguauuagaacacggcggaugcgucacaguaauggcccaagauaaaccaacaguagauauagaacucguaacaacaacaguuaguaauauggcagaaguaagaagcuacuguuacgaagccaguauaucagacauggcaagugauucaagauguccaacacagggagaagcauauuuagauaaacaaucugacacacaauauguuugcaaaagaaccuuaguagacagaggauggggaaacggaugcggacuaagcggaaaagguagcuuaguaacaugugcaaaauucgcaugcucaaagaaaaugacuggaaaaagcauacaaccagaaaacuuagaauauagaauuauguuaaguguacauggaucacaacacaguggaaugauaguaaacgacacuggacaugaaaccgaugaaaaucgagcaaaaguagaaauaacaccuaauagcccgagagcggaagccacacuaggaggauucggaaguuuaggacuagacugugaaccaagaacaggauuagacuuuagugaucuauauuauuuaaccaugaacaauaaacauugguuaguucauaaagaaugguuccaugacauaccauuaccauggcacgcaggagcagauaccgguacgccgcauuggaauaacaaagaagcucuaguagaauuuaaagaugcacaugcaaaacgacaaacuguagugguacuaggaucacaagaaggagcaguucauacagcuuuagcgggggcgcucgaagcagagauggacggugcaaaagguagauuaaguucaggacaccuaaaauguagacuaaaaauggauaaacuaagauuaaaaggaguaucguauucuuuauguacagcugcguuuaccuuuacaaaaauuccagcagaaacauuacauggaaccgucacaguugaagugcaauacgcaggaacugaugguccaugcaaagucccugcacagauggcaguagauaugcaaacgcuaacaccgguaggacgauugaucacugcgaauccugugauaacugaaagcaccgaaaauucaaaaaugaugcuggaauuagauccuccauuuggagacaguuacauaguaauaggaguaggagaaaagaaaauaacacaucauuggcacagaucaggaaguacaauaggcaaagcauuugaagcuacagugaggggagcaaaacgaauggcaguauuaggugauacagcaugggacuuuggcaguguaggaggggcacuaaauucuuugggaaaagguauacaucaaaucuuuggagcagcauuuaaaaguuuauuuggaggaaugagcugguuuucacaaauuuugauaggcacuuuauuaaugugguuaggacuaaauacuaaaaauggaucaauaucauuaauguguuuagcuuuaggaggcguauuaauauuuuuauccacagcagugagcgcuugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9102 - RNA, 2290 nt, Artificial Sequence
  ZIKV (isolate Z1106033) Polyprotein(108-794)(F398S) mRNA Design 3 opt
gggagaaagcuuaccaugacauccguaggaauuguaggauuauuacuaacaaccgcaauggcagcagaaguaacgcgacgaggaagugcauauuacauguacuuagauagaaaugacgcuggugaagcaauaaguuuuccuacaacucuugggaugaacaaauguuacauccaaauaauggaucuuggccauacaugugaugcaacaaugucauaugaauguccaauguuagaugaaggagucgaacccgacgaugucgauuguuggugcaauaccacaucaacauggguuguauauggaacaugccaucauaagaaaggagaagcgcggagaaguagacgagcaguaacauuaccaucacauucgacacgaaaauuacaaacaagaagucaaacaugguuagaaagcagagaauacacaaaacauuuaauaagaguagaaaacuggauauuuagaaauccaggguuugcauuagcagcagcagcaauagcauggcuucuaggauccaguaccucacaaaaaguaauauacuuaguaaugauauuauugauugcaccagcuuauucuauaagauguauuggaguuagcaauagagauuuuguagaagggaugaguggaggaacauggguagauguaguuuuagaacacggagguuguguaacaguaauggcacaagauaaaccaacaguagauauagagcuaguaacaacuacugugagcaauauggcagaaguucgaucauacuguuacgaagcaucaauaagugacauggcaucggauagcagauguccaacacaaggugaagcauaucuagauaaacaaucagauacucaauauguauguaaacgaacuuuaguagauagaggauggggaaauggaugcgguuuaagcggaaaaggcucauuaguuacaugugcuaaauucgcuuguaguaagaaaaugacaggaaaaucaauacaacccgaaaaucuagaauaucgaauaauguuauccguacauggaagccaacauucagguaugauaguaaaugacacaggacaugaaacagacgaaaauagagcuaaaguagaaauaacuccuaauucaccaagagcagaagcuacacuaggagguuucgguagccuaggguuagauugugaaccaagaacaggauuagacuuuucagacuuauauuaccuaacaaugaauaauaaacauugguuaguucacaaagaaugguuucacgauauaccauugccuuggcaugcaggagcagauacuggaacaccacacuggaauaauaaagaagcauuaguagaauuuaaagaugcacacgcaaaaagacagacaguugucguauuagggucacaagaaggagcuguacauacagcauuagccggagccuuagaagcagaaauggacggagcaaaaggaagacuaaguagcggacaucuuaaauguagacuaaaaauggacaaacuacgacugaaaggaguaucauauucauuauguacagcagcuuuuacauucacaaaaauaccagcugaaacccuacauggaacaguaacagucgaaguucaauacgcaggaacggacggaccauguaaaguaccagcucaaauggcaguagacaugcagacuuuaacaccaguagggaggcuaauuacagcaaacccuguuauaacagaaucaacggaaaacucaaaaaugauguuggaauuagauccaccuuuuggagacucauacauaguaauaggaguaggagaaaagaaaauaacacaucacuggcaucgaaguggaucaacuauugguaaagcauuugaagcaaccguaagaggagcuaaaagaauggcuguuuuaggugauacagcgugggauuuuggcucagugggaggugcauuaaacucuuuaggcaaagggauacaccaaauauuuggugccgcauuuaaaucauuauucggaggcaugucaugguucagccaaauauuaauaggaacauuauuaaugugguuaggucuaaacgcaaagaacggaaguauuucucuaauguguuuagcauuaggaggaguucuaauauuucuaucaaccgcaguuucagcaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9103 - RNA, 2278 nt, Artificial Sequence
  ZIKV (strain MR 766) Polyprotein(108-790)(F398S) mRNA Design 3 opt
gggagaaagcuuaccaugacaucaauuggaauaaucggcuuauugcuaacuacagcaauggcagcugaaauuacaagaagaggaucagcuuauuauauguaucuagacagaucagaugcugguaaagcaauuucauucgcaacaacacuaggcguaaauaaaugucacguacaaauaauggauuuaggccauaugugcgaugcaacaaugucguaugaauguccaauguuagacgaaggaguggaacccgaugauguagacuguuggugcaacacaacuucaacauggguaguauacggaacaugccaucacaaaaaaggagaagcaagaagaucaagacgagcaguuacucuaccaagccauaguacaaggaaacuacaaaccagaucacaaacauggcuagaaucacgugaauacacaaagcauuuaauaaaaguagaaaacuggauauuuagaaauccaggguucgcauuaguggcaguagcaauagcauggcuauuaggaucaucaacaucacaaaaaguaauauauuuaguaaugauauuauuaauagcgccagcauauaguauacgauguauaggaguaucaaacagagauuuuguggaaggaaugucaggagguacauggguggacguaguucuagaacacggaggcuguguaacaguaauggcacaagacaaaccuaccguagauauagaacuagugaccacaacaguaucaaacauggcggaaguaaggucuuauugcuaugaagccaguauaucagauauggcaucugauagcagaugcccaacacaaggagaagcauaucuugauaaacaaucugauacacaauauguauguaaaagaaccuuaguagaucgaggauggggaaaugguuguggacuaucagguaaagguucauuagucacaugugcuaaauucacuuguaguaaaaaaaugacaggaaaaucuauacaaccagaaaaucuugaauauaggauaauguuaaguguccacggaagucaacauucagggaugauagguuaugaaacagaugaagacagggcaaaaguagaaguaacaccaaacagcccaagagcggaagcaacauuaggaggauucggaagccucggacuagacugugaaccacggacgggauuagacuucagcgaucuuuauuauuuaacaaugaauaauaaacacuggcuaguucauaaagaaugguuccaugauaucccucuaccauggcaugcaggagcagauacaggaacaccccacuggaauaauaaagaagccuuaguagaauuuaaagaugcccacgccaaaagacaaacgguaguuguauuaggaucacaagaaggagcaguacauacggcguuagcuggcgcccuagaagcagaaauggauggugcgaaaggaagacuauuuucaggccaucucaaaugcagauugaaaauggauaaacuuagacuaaaaggaguaucauauucauuauguacagcagcauuuacauuuaccaaaguaccagcagaaacauuacauggaacaguuacaguagaaguucaauaugcagguacagauggaccuuguaagauaccaguacaaauggcgguagauaugcaaacacucacuccaguugguagauuaauuacugcaaacccaguaauaacagaaucgacggaaaauucuaaaaugauguuagaauuagacccaccauuuggagauaguuauauagugauaggugugggagauaaaaaaauaacacaucauuggcaucgaucagggucaacuauagguaaagcauucgaagcaacagugagaggggcaaaaaggauggcaguacuaggagauacugcaugggauuuuggcagugucggugggguuuuuaauagccuagguaaaggaauacaccaaauauuuggcgcagcguucaaaucauuauuuggcggaaugucaugguuuucucaaauacuuauaggaaccuuacuaguaugguuggguuuaaacaccaaaaauggaaguauuucacuaacauguuuagcccugggaggaguaaugauauuucuaagcacagcaguaagugcaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9104 - RNA, 2290 nt, Artificial Sequence
  ZIKV (strain NatalRGN) Polyprotein(108-794)(F399S) mRNA Design 3 opt
gggagaaagcuuaccaugacaucaguaggaauaguaggacuacuauuaacaacagcaauggcagcugagguaacaagaagaggaagcgcuuauuauauguauuuagauagaaaugaugcaggagaagcuaucagcuucccaacaacacuaggaaugaacaaauguuauauacaaauaauggauuuaggccacaugugcgaugcaacaaugagcuaugaauguccaauguuagaugaaggaguagaaccugaugauguugauuguuggugcaacaccacaaguacauggguaguuuauggaacaugccaucacaagaaaggugaagcacgaagaucaagacgagcaguaacacugccaucucauucaacacgaaaauuacagacaagaagucagacauggcuugaaaguagagaauauacgaaacaccuaauacgcguagaaaauuggauauuuagaaacccuggauuugccuuggcggcagcagcaauagcuugguuauuagguucuaguacaucacaaaaaguaauauaucuaguaaugauacuacuaauagcaccagcauacucaauaagaugcauaggaguaagcaacagagauuucguagaaggaaugaguggaggaaccuggguagauguaguccuagagcacggaggauguguaacaguaauggcacaagacaaaccaacuguagauauagaacuuguaacaacaacgguaucaaacauggcagaaguacgaaguuacugcuacgaagcaucaauaucugacauggcuucagauucaagaugcccaacacaaggagaagccuaucuagauaaacaaucagacacacaauacguuugcaaacgaacauuaguagaccgagguuggggaaacggaugugggcuaucagggaaagguucacuuguaacaugugcaaaauuugcaugcucaaagaaaaugaccgguaaaaguauucaaccagaaaaucuagaauacagaauuaugcuaucaguacacggaucacaacauagugguaugauaguaaaugacacuggacaugagacugaugaaaauagagcaaaaguagaaauaacaccaaauaguccaagagcagaagcaacauuaggaggauuugguaguuuaggacucgacugugaaccacggacugggcuggauuuuagugacuuauauuacuuaaccaugaauaauaaacacugguuaguacacaaagaaugguuccaugauauaccuuugccauggcaugcuggugcagauacaggaacuccccauuggaauaauaaagaagcacuuguagaauuuaaagaugcacacgcaaaacgacaaacaguaguuguacuagguucccaagaaggagcaguacauacagcacuugcaggagcucuagaagcugaaauggauggagcuaaaggacgauuaaguaguggacaccuaaaauguagacuuaaaauggacaaauuaagguuaaaaggaguaaguuauucauuauguacagcagcauucaccuucacuaaaauaccugcggaaacacuccacgguacaguaacuguagaaguacaauaugcaggaacagauggaccauguaaaguaccagcacaaauggcuguggauaugcaaacacuaacucccguaggaagacuaauaacugcaaacccaguaaucaccgagaguacagaaaacucuaaaaugauguuagaauuagauccaccauuuggagauucauacauuguaauuggaguaggugaaaagaaaauaacucaccauuggcauagaucuggaaguacaauaggaaaagccuucgaagcaacaguaagaggugcuaaacggauggcaguauuaggagauacggcaugggauuuugguucuguagguggagcacuaaacucccuagggaaagggauucaccaaauuuuuggagcagcauuuaaaucauuauuuggaggcaugagcugguuuucacagauacuaauagguacauuacuuaugugguuggguuuaaacacuaaaaacgguucaauuucauuaaugugcuuagcacuaggugguguguuaauauuucuaaguacagcgguuagugcuugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9105 - RNA, 2290 nt, Artificial Sequence
  ZIKV (strain ZikaSPH2015) Polyprotein(108-794)(N444Q) mRNA Design 3 opt
gggagaaagcuuaccaugaccagcguaggaauuguagggcucuuauuaacaacagcuauggcagcagaagugacaagaagggguagugccuauuacauguacuuagauagaaaugacgcaggugaagcaauuucauuuccaacaacauuaggaaugaauaaauguuacauacaaauaauggaccuaggacauaugugugacgcaacaaugaguuaugaaugucccauguuagacgaggggguugaaccagaugauguagauugcugguguaauacaacgaguacguggguaguauauggaacgugucaucauaaaaaaggagaagcucguagaaguaggagagcaguaacuuuaccaagucacucaacaagaaaauuacaaacaagaagccaaacaugguuagaaucaagagaauauacaaaacaucucauaagaguagaaaauuggauauuuagaaauccaggauuugcauuagcagcugcugcaauugccugguuacucggaaguuccaccucacaaaaaguaauauaccucguaaugaucuuguuaauagcaccagcuuauucgauaagauguaucggaguuaguaauagagauuuuguugaaggcaugagcggagggacauggguagauauaguacuugaacauggcggauguguuacaguaauggcacaagauaaaccaacgguagauauugaauuaguaacaacaacagucaguaacauggcugaaguaagaucauauugcuaugaagcuaguauaucugauauggcuagugauaguagauguccaacucaaggagaagccuauuuagauaaacaaagugacacucaauauguuuguaaaagaacauuaguagacagaggauggggaaaugguuguggauuauucggaaaaggaagcuugguaacaugugcaaaauucgcauguaguaaaaaaaugacaggaaaaucuauucaaccagaaaacuuagaauauaggauaauguuaucagugcacggcucacaacauaguggaaugauaguacaagacacagggcaugaaacagaugaaaauagagcaaaaguagaaauaacuccaaacaguccuagagcugaagcaacucuagguggauuuggaaguuuaggcuuagauugugaaccaaggacaggauuagauuuuagugauuuauauuaccuaacaaugaauaauaaacauuggcuuguacauaaagaaugguuccaugauauuccacuaccauggcaugcaggagcagacacugguacuccacauuggaauaacaaagaagcauuaguugaauuuaaagaugcccaugcuaaaagacaaacaguaguaguauuaggaagucaagaaggagcuguucacacugcacuugcaggagcacuagaagcagaaauggauggagcaaaaggacgguuaagcaguggacauuuaaaaugcagacuaaaaauggauaaacuucgauuaaaagggguaucauauaguuuauguacugcagcuuuuacguuuacaaaaauaccagcggaaacacuacauggaacaguuacaguugaaguacaguaugcaggcacugauggaccuuguaagguaccagcgcaaauggcaguagacaugcaaacacuaacuccagugggacgacuaauaacagcaaauccaguaauaacagaaagcacagaaaauaguaaaaugaugcuagaacuagacccaccauuuggagacucauacauagucauaggcguaggagaaaaaaaaauaacccaucauuggcacagaaguggaucaacuauaggaaaagcauuugaagcaacaguucguggagcaaagagaauggcaguauugggagacaccgcaugggauuucgguaguguuggaggugcacuuaauucauugggaaaaggaauacaucaaauuuuuggagcagcuuucaaaaguuuauucggcgggaugucaugguucagucaaauauuaauagguacuuuacuaaugugguuaggauuaaauacaaaaaaugguagcauuucacuuaugugucuagcauuaggagguguuuugauauuucuaucaacagcugugucagcuugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9106 - RNA, 2290 nt, Artificial Sequence
  ZIKV (isolate Z1106033) Polyprotein(108-794)(N444Q) mRNA Design 3 opt
gggagaaagcuuaccaugacaucagucggaauagucggacuucuauuaacuacugcaauggcagcagaagucacaagaagaggaucagcuuauuacauguacuuagauaggaaugaugcuggagaagccauuagcuuucccaccacuuuaggcaugaauaaauguuacauacaaauaauggauuuaggacauacaugugaugcaacaaugucauacgaaugucccauguuagaugaagguguagaaccagaugauguugauuguuggugcaauacaacaucaacauggguaguauacggaacaugccaucauaagaaaggagaagcaaggcgaucaagacgagcaguuacauugccuagucauaguaccagaaaauuacaaacaagaucucaaacaugguuagaaaguagagaauacacaaaacaucuaauaagaguugaaaacuggauauucagaaauccaggauuugcacuagcagcagcagccauagcauggcuauuaggaucaagcacaagucaaaaaguuauauacuuagugaugauauuauuaauagcaccagcuuacucuauaagauguaucggagucuccaacagagauuuuguagaaggaaugucaggaggaacauggguugauguaguauuagaacaugguggauguguaacaguaauggcacaagauaaaccaaccguagauauagaauuagucacaacaacuguaucaaauauggccgaaguaagaaguuacuguuaugaagcaucaauuucugacauggcuucagauagccgcugccccacacaaggcgaggcauauuuagacaaacaaagcgauacacaauauguauguaaaagaacucuaguugauagaggaugggguaauggauguggacuauucgguaaagguucauuaguaacaugugcaaaauuugcuuguagcaagaaaaugacagggaaaucaauccaaccagaaaaucuagaauauagaauaauguuaucagugcacggaagucagcacucagguaugauaguucaagauacaggacaugaaacagacgaaaauagagcaaaaguggaaaucacgccaaauucaccaagagcugaagcuacccuagguggcuuuggaucauuaggcuuagauugcgaaccaaggacaggauuagauuuuucagaucucuacuauuuaacaaugaauaauaaacacuggcuaguccacaaagaaugguuccaugauaucccauugccuuggcaugcuggagcagauacagguacaccacauuggaauaacaaagaagcacucguagaguucaaagaugcacaugcaaaaagacaaacaguaguaguacuaggaucccaagaaggugcaguucacacugcacuggcaggagccuuagaagcagaaauggauggagcaaaaggaagauuaucaaguggacaccuaaaauguagauuaaaaauggauaaacuaagauuaaaaggaguauccuauucccucugcaccgcagccuucacuuuuacuaaaauaccagcagaaacauugcauggaacaguuaccguagaaguacaauacgcaggaacugauggacccuguaaaguacccgcacaaauggcaguagauaugcaaacacucacaccaguaggaagauuaauaacagcaaauccaguaauaaccgaaucaacagaaaacagcaaaaugaugcuugaauuagauccaccuuuuggagauucauauauaguaauugguguaggcgaaaagaaaaucacacaucauuggcauagaaguggaucaaccauaggaaaagcauuugaagcaacaguaagaggggcaaaacgaauggcgguccuaggagacacggcaugggauuuuggaucaguaggaggagcauuaaauucacuaggaaaaggcauucaucaaauauucggagcugcauucaaaaguuuauucggaggaaugucaugguuuagucaaauacuuauaggcacauuauuaauguggcuaggauuaaacgccaaaaaugggucaauaucacucauguguuuagcuuuagguggaguauuaauauuuuuauccacagcaguaucugcaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9107 - RNA, 2290 nt, Artificial Sequence
  ZIKV (strain NatalRGN) Polyprotein(108-794)(N444Q) mRNA Design 3 opt
gggagaaagcuuaccaugacaagcgugggaauaguuggacuacuauuaacaacagcaauggcagcagaagugacucgucggggaagugcauauuauauguauuuagauagaaaugacgcaggagaagcaauuaguuuuccaacaacauuaggaaugaauaaauguuacauacaaauuauggaucuaggacacaugugugaugcaacaaugucauaugaauguccgaugcuagacgaaggaguagagccagaugauguugacugcuggugcaauacaacaagcacauggguagucuacggaacuugccaucauaagaaaggagaggcacgaagaagccggagagcuguaacuuuaccuagccauucuacucgaaaauuacaaacaagaucacaaacuuggcuagaaagucgagaauauacaaaacauuuaauaagaguagaaaacuggauauuccguaauccuggguuugcucuugcagcagcagcaauagcguggcuacuaggaaguagcacaagucaaaaaguaauauacuuagugaugauauuauuaauagcuccagcauauucaauuagauguaucggugugaguaauagagauuucguagaaggaaugaguggagggacuuggguagauguaguuuuagaacacggaggaugugucacagugauggcucaagacaaaccaacuguagacauagaacuuguaacuaccacaguaucaaacauggcagaaguuagaaguuauuguuaugaagcaucuauaucagauauggcaucagauucacgauguccaacacaaggcgaagcguaucuagauaaacaaucggauacucaauauguauguaaaagaacuuuaguagauagaggauggggaaauggauguggccuauucggaaaaggaucauuagugacaugcgcuaaauuugccuguagcaagaaaaugaccgguaaaaguauucaaccagaaaauuuagaauauagaauaauguuaucaguucacggaucacaacauaguggaaugauaguucaagauacaggccacgaaacugacgaaaauagagcaaaaguagaaauaacaccaaauucuccaagagcagaagcaacacuaggcggauuuggaucauuaggauuggauugugaaccucgaacaggauuagacuuuagugauuuguauuauuuaacaaugaacaacaaacauugguuaguacacaaagaaugguuucacgauauaccacuaccauggcaugcaggagcagauacgggaacaccccauuggaauaauaaagaagcgcuuguagaauuuaaagaugcucaugcaaaaaggcaaacaguaguaguauuaggaagucaagaaggagcaguacauacagcucuagcuggagcccuggaagcugaaauggauggggcuaaaggaagacuuagcucaggacaucuaaagugccgauuaaagauggacaaauuaagauuaaaaggcguaaguuauucuuuauguacagcagcauuuacauuuacaaaaauaccagcagaaacgcugcaugguacuguaacaguagaaguacaauaugcaggaacugacggaccauguaaaguaccagcacaaauggcgguugauaugcaaacauuaacaccuguaggaagacucauuacagcaaacccaguuauaacagaaucuacagaaaauuccaagaugaugcuggaguuagaucccccauuuggugauaguuauauaguuaucgguguaggugagaagaaaauaacacaucacuggcaccgaaguggaucaacaauagguaaagcauucgaagcaacaguaagaggagcaaaaaggauggcaguauuaggugacacagccugggauuuuggaucuguaggaggagcacuuaauucauuaggaaaaggcauucaccaaauauuuggagcagcauuuaaaucauuauucgguggaaugucaugguuuucacaaauuuugauagguacacuacuaauguggcuaggacuaaacaccaaaaaugggucaauaagucuaaugugcuuagcguuaggaggaguacuaauauuccuaaguacagcaguaucagcaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9108 - RNA, 2290 nt, Artificial Sequence
  ZIKV (strain ZikaSPH2015) Polyprotein(108-694)-Cterm-JAEV1-E(400-500) mRNA Design 3 opt
gggagaaagcuuaccaugacauccguagguauaguagguuuacuauuaacuacugcgauggccgcagaagucacaagaagagguucagcuuacuauauguaucuagaucguaaugacgcaggagaagcaauaucauucccuacaacauuagguaugaauaaauguuauauccaaauaauggauuuagggcauaugugugaugcaacaaugaguuaugaaugcccaaugcuagaugaaggaguagaaccagacgacguugacugcugguguaauacaacaagcacauggguaguauacggaacaugucaccauaaaaaaggagaagcucgaaggucacgacgagcgguuacauugccaucucauaguacaagaaaacuacagacaagaucacagacauggcuagaaaguagagaauacacaaaacaucuaauucgaguagaaaacuggauauuuagaaauccaggcuuugcacucgcagcagcugcaauagcauggcucuugggaaguucaacaucacagaaaguaauauaccuaguaaugauauuacuuauagcaccagccuauaguauuagguguauaggaguaucuaauagagauuuuguagaaggaaugagcggagggacauggguagauauaguacuagaacauggaggauguguaacuguaauggcacaagauaaaccaacaguugacauagaacuaguaacaacaacaguaucaaauauggcagaaguaagaaguuauuguuaugaagcgaguauaagugauauggcaucagauucaagaugcccuacacaaggagaagcauaccuagacaaacaaucggauacacaauauguauguaaaaggacauuaguugauagagguugggggaacggauguggguuauucggaaaaggaaguuuaguaaccugcgccaaauuugcauguaguaagaaaaugacagggaaaaguauccaaccugaaaaucuggaauacagaauuauguuaagugugcauggaagucaacacaguggaaugauaguaaaugauacgggacacgaaacagaugaaaauagggcaaaagucgaaauuacaccaaacagccccagagcagaagcaaccuuaggaggauuuggaucauuaggauuagauugcgaaccaagaaccggauuagacuuuagcgaucuguacuauuugacaaugaauaauaaacauuggcuaguacauaaagaaugguuccaugauauaccauuaccauggcacgcaggugcugauacuggcacaccacauuggaacaacaaagaagcacucguugaauucaaagacgcccaugcaaaacgacaaacaguagucguuuuaggaucacaagaaggagccguacacacugcauuagcaggagcauuagaagcagaaauggauggcgccaaagggagacuaucgaguggucaucuuaagugcagacuaaaaauggauaaauuaagguuaaaaggaguaaguuacucucuaugcacagcagcauuuacauuuacuaaaauaccugcugagacauuacauggaacuguaacuguagaaguacaauacgcagggacugauggaccauguaaagugccagcacaaauggcaguagauaugcaaacauuaacaccaguaggacgauuaauaacggcaaauccaguaaucacugaaucaacugaaaauaguaaaaugauguuagaguuagauccaccauucggcgauaguuauauaguaauaggagugggcgaaaaaaaaaucacucaucauuggcacagaagcggcaguacauuaggaaaagcauucagcacaacauuaaaaggagcucaaagauuagcagcacuaggugauacagcaugggauuucggaucaauuggaggaguauucaauucaauagggagagcagugcaucaaguauucgguggcgcauuuagaacucuguucggaggaaugaguuggauaacacaaggacuaaugggugccuuauuauuauggaugggaguaaaugcacgagaccgaucaauagcacuagcauuucuagcaacuggagguguauuaguauuucuggcaacuaacguccacgcaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9109 - RNA, 2290 nt, Artificial Sequence
  ZIKV (isolate Z1106033) Polyprotein(108-694)-Cterm-JAEV1-E(400-500) mRNA Design 3 opt
gggagaaagcuuaccaugaccaguguaggaauaguagguuuacuccuuaccacagcaauggcggcagaaguaacacggagaggaucugcauauuacauguaccuugacagaaaugacgcgggagaagcaauaaguuucccaacaacacuagggaugaauaaaugcuacauucaaauuauggaucuaggacauacaugugaugcgacgaugagcuaugaaugcccaauguuagaugaagguguagaaccagaugauguagacugcugguguaauacuacaucgaccuggguuguauauggaacaugucaucauaagaaaggagaagcacgaagaagcaggagagcaguaacauuacccagucauucaacaagaaaauuacaaaccagaucacaaacauggcuagaaucaagagaauauacaaaacauuuaauaagaguagaaaacuggauuuuuagaaauccaggauuugcauuagcugcugcagcuauagcauggcuucuuggcaguucaaccagccaaaaaguuauauauuuggucaugauuuugcuaauagcaccagcauauaguauacgauguauaggaguaucaaauagagacuuuguugaaggaaugucuggaggaacaugggucgauguaguacuagaacauggaggauguguaacaguaauggcacaagauaaaccaacaguugauauagaauuaguaacaacaacaguaucgaauauggccgaaguaagaaguuauuguuaugaagcaucaauauccgauauggcaucagauagcagauguccaacucaaggagaagcauaccuagauaaacaaucagauacucaauauguuuguaaaagaacauuaguugacagaggcugggguaauggaugcgguuuauucggcaaaggcucauuaguaacaugugcaaaguuugcauguucaaagaaaaugacaggaaaaucaauacaaccagaaaauuuagaauaucgaauaauguuaaguguacauggaucccagcacucaggaaugauaguuaaugauacaggucacgaaaccgaugagaauagagcaaaaguagagauaacuccaaauaguccaagagcagaagcuacauuaggaggauuugguagcuuagguuuagauugugaaccacgaacaggauuagauuucagugaucuauauuaucuaacuaugaauaauaaacacugguuaguacauaaagaaugguuucaugauaucccacuuccauggcaugcaggagcagauacaggaacaccccauuggaauaauaaagaagcauuggucgaauuuaaagaugcacaugcaaaaaggcaaacaguuguaguguuaggaucacaagaaggagcuguacacacagcacuugcuggugcacuugaggcagaaauggauggagcaaaaggaagacugagcagcgggcauuuaaaauguagauugaaaauggauaaauuacgccugaaaggaguaaguuauagucuauguaccgcagcauuuacauuuacaaaaauaccagcugaaacgcuacauggaacggucacaguagaaguacaauaugcagguacagauggaccauguaaaguaccagcacaaauggcaguagacaugcaaacacuaacaccaguuggaagauugaucacugcaaauccaguuauaacagaaucaacugaaaauucgaaaaugauguuagaguuagacccuccguuuggugacucauauauaguaaucggaguaggagaaaagaaaauaacacaucacuggcauagaucaggaaguacacuaggaaaggcuuuuagcacaacauuaaaaggugcucaaagauuagcagcauuaggcgauacagcuugggacuuuggaucaauaggcggaguauuuaacaguauaggaagggccguacaucaaguauuuggaggagcauuuagaacacucuuuggaggaaugagcuggauaacacaagguuuaaugggagcauuauuacuuuggaugggaguaaaugcacgagaucgaaguauagcauuagcauuucuagcaacugguggaguccuaguauuucuagcaacaaacguacaugcuugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9110 - RNA, 2278 nt, Artificial Sequence
  ZIKV (strain MR 766) Polyprotein(108-690)-Cterm-JAEV1-E(400-500) mRNA Design 3 opt
gggagaaagcuuaccaugacaucaauagguaucauaggccuauuacuaacuacagcaauggcagcagaaauaacuagaagagguucagcauauuacauguaucuagauagaagugaugcagguaaagcaauaaguuuugcaacaacauuaggaguaaauaaaugccauguacaaauaauggaucuaggucauaugugugacgcaacaaugaguuaugaaugcccuaugcuagacgaaggaguugaaccugaugacguagauuguuggugcaacacaacaaguacuugggugguauauggaacuugucaucacaagaaaggagaagcaagacgaucaagacgagccguaacucuaccaucucacucaacaagaaaacuacaaacacgcucacagacaugguuagaaucaagagaauacacuaaacauuuaauuaaaguugaaaacuggauuuuucgaaauccagguuuugcauuaguagcuguagccauagcauggcuacuaggaaguucuacaucucaaaaaguaauauaucuuguaaugauacuacuaauagcuccagcauauucaauuagauguauaggaguaagcaauagagauuucguagaaggaaugaguggaggaacauggguagauguaguauuagaacauggugguuguguaacaguaauggcacaagacaaaccaacagucgacauagaauuaguuacaacuacgguaaguaacauggcagaaguuaggaguuauuguuaugaggcaucaauaagcgauauggcgucagauucaagaugcccaacacaaggagaagcauauuuagacaaacaaagugauacgcaauacguauguaaaagaacucuaguagacagggguuggggaaauggaugcgguuuauuuggaaaaggcagucuaguaacaugcgcaaaauuuacauguucaaagaaaaugacaggaaaaucuauucaaccugagaauuuagaauaucgaauaauguuaucuguacauggaucucaacauucaggaaugauaggguaugaaacugacgaagauagagcaaaaguagaaguaacgcccaauucuccaagagcagaagcaaccuuaggcggauuuggaaguuuaggacuagauugugaaccaagaacaggucuagacuuuucagaucucuacuaucuaacaaugaauaauaaacacuggcuugugcauaaggaaugguuucaugauaucccauuaccauggcaugcaggagcagacacaggaacaccucauuggaauaauaaagaggccuuaguagaauuuaaagaugcacaugcgaaaagacaaacaguaguaguuuuaggaagucaagagggagcaguucauacagcauuagccggagcacuugaagcggaaauggauggagccaaaggacgucuauuuaguggacacuuaaaaugcagauuaaaaauggauaaacuuagacuaaaaggugucucauacucucuaugcacagccgcguuuacauuuaccaagguaccagccgaaacacuucacggaaccguaacuguagaaguacaauaugcaggaacagauggaccauguaaaauuccuguacaaauggcaguagauaugcaaacauuaacacccguagguagauuaauaacagcaaaucccguaauuacagaaucaacagaaaauaguaaaaugauguuagaacuagauccuccauuuggagauucauauauaguaauaggaguaggugacaagaaaauaacacaucauuggcacagaagugguagcacauuaggaaaagcauuuaguacaacacucaaaggagcacaaagauuagcagcacuaggagauacagcaugggacuuuggaagcauuggagguguauuuaauaguaucgguagagcaguucaucaaguguuuggaggagcauucagaacacuauuuggagguaugucuuggauuacacaagguuuaaugggugcauuauuauuguggaugggaguaaaugcacgagaucguucaauagcauuggccuuuuuagcaaccgguggaguccugguguuuuuagcaacuaauguccaugcaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9111 - RNA, 2290 nt, Artificial Sequence
  ZIKV (strain NatalRGN) Polyprotein(108-694)-Cterm-JAEV1-E(400-500) mRNA Design 3 opt
gggagaaagcuuaccaugacaucuguagguauaguaggacuccuuuuaacaacagcaauggcagcagaaguaacgagaagagguagcgcauauuauauguauuuagauagaaacgacgccggagaagcaauuagcuuuccuacaacauuaggcaugaauaaauguuauauacaaauaauggaccuuggacauaugugugaugcaacuaugagcuaugaaugcccuaugcuagaugagggaguagaaccagaugacguagauuguugguguaacacaacaagcacaugggucguuuauggcacaugccaucauaaaaaaggagaggcaagacguagucgaagagcaguaacacuaccaucgcauucaacacgaaaauuacaaacuagaagccaaacauggcuagaaucacgagaguacacaaaacauuuaauaagaguagaaaacuggaucuuuaggaauccugguuuugcacuagcagcagcagcaaucgcauggcuacucggaaguaguacgagucaaaaaguaaucuaucuaguaaugauuuuacuaauagcacccgcuuacucaauaagguguauagguguaucaaauagagauuuuguggaagguaugagugguggaacauggguugauguaguacuagaacauggaggaugugucacaguuauggcucaagauaaaccaaccguugauauagaguuaguuacuacuaccguuuccaauauggcagaaguaagaagcuacugcuaugaagcaagcaucucagauauggcaucagauucaagaugcccaacccagggagaagcauauuuagacaaacaaucagauacacaauauguaugcaaaaggacauugguugauagaggaugggguaauggaugcggauuauuuggcaaaggaucucuaguaaccugugcuaaauucgcaugcucuaaaaaaaugacaggaaaaucgauucaaccggaaaaucuugaauaccgaauaaugcuuucaguacauggaagccaacauucaggaaugaucguaaacgauacaggucacgaaacagaugagaauagagcuaaaguagaaauaacuccaaauagcccacgugcugaagcuaccuuaggaggauuugggucuuuaggauuagauugcgaaccacgaacaggauuagauuucucagaccucuauuaucucacaaugaacaauaaacauugguuaguccauaaagaaugguuccaugacaucccacuaccauggcacgcaggugcggacacuggaacaccgcacuggaacaacaaagaagcacuagucgaauucaaggaugcucacgcaaaaagacaaacaguaguaguacugggaucacaagaaggagcaguacacacagcuuuagcaggagcauuagaagcagaaauggacggagcaaaaggaagauuaagcagcggacaucuuaaauguagauuaaaaauggauaaauugagauuaaaaggagucucguauucauuaugcacagccgcauuuacauuuacaaaaauacccgccgaaacacuacauggaacaguuacugucgaaguacaauaugcagggacagacgguccauguaaaguaccugcacaaauggcaguugacaugcaaacacuaacaccaguaggaagauuaaucacagcaaacccaguaauaacagaaucuacagaaaacaguaaaaugauguuagaauuagauccaccuuuuggcgauuccuauauaguaauuggaguaggagaaaaaaaaauuacacaucauuggcauagaagugguucaacacuaggcaaagcuuuuucaaccacacuaaaaggugcucagcgacuagcagcacuuggagauacagcaugggauuucggaaguaucggaggagucuuuaacucaauaggucgagcaguucaucaaguauucggcggagcauuuagaacacuauuugguggaaugucauggauaacacaaggacuaaugggagccuuauuauuauggaugggaguaaaugcgagagauagaaguauugcauuagcauuuuuagcaacugguggaguacuaguauuuuuagcaacuaacguacaugcgugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9112 - RNA, 2365 nt, Artificial Sequence
  ZIKV (strain ZikaSPH2015) Polyprotein(93-804) mRNA Design 3 opt
gggagaaagcuuaccaugagaauuauaaacgcucgaaaagaaaaaaaaagacgaggagcagauacaaguguugguauaguagguuuauuguuaacuacugcaauggcagcagaaguaacaagacgaggaagcgcuuauuauauguaucuagacagaaaugaugcaggagaagcgauaaguuucccaacuacauuagguaugaauaaauguuacauacaaauaauggauuuagggcauaugugugaugcaacaaugaguuaugaaugcccaauguuagaugagggaguagaacccgaugacguagauugcuggugcaacacuacaagcacauggguaguauaugguacaugucaucauaaaaaaggcgaagcaagaagaagccgaagagcaguuacacuaccaucacauucaacaagaaaacuucaaacgcgaucacagacuuggcuagaaucaagagaauauacaaaacaucuaauuaggguagaaaauuggaucuucagaaacccaggauuugcgcuagcagcugcugcuauugcuugguuauuaggaucaucaacaagccaaaaaguaauuuaucuugugaugauucuacuaauugcacccgcauauucuauacgcugcauaggagugucgaaccgagauuuugucgaaggaauguccgggggaaccuggguagauaucguauuagaacauggagguuguguuacugugauggcacaagauaaaccaacaguagauauagaauuaguuacaacaacaguaagcaauauggcagaaguuagauccuacuguuaugaagcauccauuagcgauauggcuagugauagcagauguccaacacaaggagaagcuuacuuagauaaacaaagugacacacaauauguaugcaaaaggacauugguagaccgaggauggggcaauggaugcgguuuauucgguaaaggcucauuaguaacuugugcaaaauuugcguguucaaaaaaaaugacaggaaaaaguauacaaccagaaaauuuagaauacagaauaauguuaucaguacacggaucccaacacucaggaaugauaguaaaugacacaggacaugaaacagaugaaaacagagcaaaaguagagauaacaccaaauucaccaagagcugaagccacauuaggaggauucggaaguuuagguuuagacugugaaccaagaacuggauuagauuuuagcgacuuauauuauuuaacaaugaacaauaaacauugguuaguacauaaagaaugguuucaugauauaccauuacccuggcaugcaggagcugauacagggacuccccauuggaacaauaaagaagcacuuguagaauucaaggaugcacaugcgaaaagacaaacaguaguagucuuaggcagccaagaaggggcaguucacacagcauuagcaggagcuuuagaagcggagauggauggcgcaaaaggaagauuaagcucaggccacuuaaaaugcagguuaaagauggacaaauuaagauuaaaaggaguaaguuauagccuaugcacagcagcauuuacauucacuaaaauaccagccgaaacauuacacggaaccguuacuguugaaguacaauacgcaggaacagacggacccugcaaaguaccagcucaaauggccguagauaugcaaacauuaacucccguugggagacuaauaacagccaauccaguaauaacagaaaguacugaaaauucaaaaaugauguuagaauuagauccaccuuuuggagacucauacauaguuauagguguaggggaaaagaaaauaacacaccacuggcacagaucaggcucaacuauugguaaagcauuugaagcuacagucagaggcgcgaaaagaauggcaguacuaggagauacagcaugggauuucggaucaguuggaggggcauuaaacaguuuaggaaaaggaauacaucaaaucuucggagcagcuuucaaaucuuuauuuggagguaugucuugguuuucucagauacuaauagguacauuauuaaugugguuaggacuaaauacaaaaaaugggucaaucucuuugauguguuuagcacuagguggaguguugauauuuuuaucaacagcaguaagugcagacguagguuguucaguagauuuuucaaaaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9113 - RNA, 2362 nt, Artificial Sequence
  ZIKV prME variant mRNA Design 3 opt
gggagaaagcuuaccaugauaauuaacgcuaggaaagaaaaaaaacgaagaggggcagauacauccguaggcauaguagguuuguuauuaacaacagccauggcagcagaaguaacacgaagaggcucagcauacuacauguauuuagauagaaaugaugcaggagaagcaauaagcuuuccaacuacauuaggaaugaauaaauguuauauacaaaucauggaucuaggacacaugugugaugcgacaaugucauaugaaugcccaauguuggaugaaggaguugaaccagaugaugucgauugcugguguaauacaacaaguacauggguaguauauggaacaugccaucauaaaaaaggagaagccagaagaagcagacgcgcaguaacacucccaucucauaguacaagaaaacuacaaacaagaucucaaaccuggcuagagagcagagaauacacaaaacauuuaauaagaguagagaauuggauuuucagaaauccuggauuugcccuggcagcagcagcuauugcauggcuacuugguucgagcacgagccaaaaaguaaucuaucucguuaugauacuacuaauagcuccagcuuacagcauaagauguauuggaguaucaaauagagauuuuguagaagguaugucaggaggaacauggguagauaucguuuuagaacauggaggauguguaacaguaauggcgcaagacaaaccaacgguagacaucgaauuaguaacaacgacaguaaguaauauggcagaaguaagaaguuacugcuacgaagcaaguauuucagauauggcaucagacucacgauguccaacacaaggagaagcauauuuggauaaacaaucagacacacaauauguaugcaaaagaacacuaguagacagaggaugggggaacggauguggacuuuuuggaaaagguucuuuaguaacaugugcaaaauuugcgugcucaaaaaagaugacaggaaaaaguauacaaccagaaaaucuugaauauagaauaauguuaucaguacacgggagccagcauagcggcaugauaguuaacgacacuggacacgaaacagacgaaaacagagcuaaaguagaaauaaccccaaauagucccagggcagaagcaacguuaggaggauuuggaaguuuaggacuagacugugaaccacgaacaggacuagauuuuagcgaucuauacuacuuaacaaugaacaacaaacacuggcuaguccauaaagaaugguuucaugacauaccguuaccauggcaugcaggagccgacaccggaacuccacauuggaauaacaaagaggcauuaguagaauuuaaagaugcacaugcaaaaagacagacuguaguaguacuaggaagucaagaaggagcuguacacacagcacuugcaggagcauuagaagcagaaauggacggagcaaaagggcgguugucauccggacaucuaaaaugucgauuaaaaauggacaaauuaaggcuuaaaggaguaucuuacagucuaugcacagcagcauuuacauuuacaaaaauaccagcagaaacauuacaugguacaguaacaguugaaguacaauaugcaggaacagauggcccauguaaaguuccagcacagauggcaguagauaugcaaacuuuaaccccaguaggaagauugauaacagcuaaucccguaauaacagaaaguacagaaaauucaaaaaugauguuagaacuggauccaccauuuggagauagcuauauaguaauaggaguaggagagaaaaagauaacacaucauuggcacagaaguggaagcacaaucggaaaagcuuuugaagcaacgguaaggggcgcaaaaagaauggcaguauuaggagacaccgcgugggauuuuggaagcguaggaggagcauuaaauaguuuaggaaaaggaauacaucaaaucuucggagcugcauucaaaucauuauuuggugguaugucaugguuuucacaaauacuaauagguacccuucuaaugugguuaggauuaaauaccaaaaacggcagcauaagcuuaauguguuuagcauugggugguguuuuaauuuuuuuaucuacagcaguuucagcagaugucgguuguagcguggauuuuagcaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9114 - RNA, 2359 nt, Artificial Sequence
  ZIKV prME variant mRNA Design 3 opt
gggagaaagcuuaccaugauaaaugcaagaaaagaaaaaaaacgaagaggagcagacacaagugucggaauaguagguuuauuauuaacuaccgcaauggcggcagaaguaacgagaagaggaucugcauauuacauguauuuagaucguaaugaugcuggagaagcaauaucuuucccaacaacacuaggaaugaauaaaugcuauauucaaauaauggaccuaggacauaugugcgaugcaacaaugaguuaugaauguccaauguuagacgaaggaguagaaccagacgauguggacuguugguguaauacaacuagcacguggguagucuacggaacaugccaucauaaaaaaggggaagcaagaagaaguagacgagcaguaacguuaccaucacauagcaccagaaaauuacaaaccaggucacaaacuuggcuagaaucacgagaauacacaaaacaucuaauuagaguagaaaacuggauauuucgaaacccgggauuugccuuagcugcagcagcaauagcauggcuauuaggaucaaguacuucacaaaaaguaauuuaucuaguaaugauacuauuaauagcgccagcauauucaauaagguguauuggaguuagcaauagagauuuuguagaaggaaugaguggaggaacuugggucgauaucguacuagaacauggaggauguguaacaguaauggcacaagacaaaccaacaguagauauagaacuaguuacaacaacaguaaguaauauggccgaagugagaagcuauuguuaugaagccucaauaucagauauggcaagugacucaagguguccaacucaaggagaagcauaucuggauaagcaaucagacacacaauaugucuguaaaagaacguuaguagauagagguuggggaaauggauguggucucuucggaaaaggaucauuaguaacaugugcaaaauuugccugcagcaaaaaaaugacaggaaaaagcauacaaccugaaaaccuggaauauagaauaaugcucucaguacaugguagccaacauucagguaugauagugaaugauacaggacaugaaacugaugaaaaucgagcaaaaguagaaaucacgccuaauaguccgagagcugaagcuacacuaggaggauuuggaaguuuaggauuagacugugaaccaagaacaggauuagauuuuagugaccucuacuauuuaacaaugaauaauaaacauuggcucguacauaaagagugguuucacgacauaccauuaccauggcacgcaggugccgauacaggaacuccgcauuggaauaacaaagaagcauugguugaauuuaaagaugcacaugcaaagagacaaacaguaguuguuuuaggaagccaagaaggagcaguccacacagcuuuagcaggagcuuuagaggcagaaauggauggagcaaaaggaagacuuagcucuggccaccuaaaaugcagauugaaaauggauaaacugagacuaaaaggaguaucuuauagucuauguacagccgcauucacauuuacuaaaauuccagcagaaacuuuacaugguacaguaacuguagaaguucaauaugcaggaacagauggcccuuguaaaguaccugcccaaauggccguagauaugcaaacauuaacaccaguaggaagauuaauaacagcaaauccaguaauaacagaaagcaccgaaaauagcaaaaugauguuagaauuagauccaccauuuggugauaguuauauaguaauuggaguaggcgaaaaaaaaauaacacaucacuggcauagaucagggucaacaauagguaaagcauuugaagccacaguaagaggagcaaaaagaauggcaguuuuaggagauaccgccugggacuuugguucaguaggaggagcucuuaauucuuuaggaaaaggaauacaccaaauauuuggcgcagcauuuaagaguuuauucggaggaaugucaugguuuucacaaauucuaauaggaacguuauuaauguggcuagguuuaaauacaaaaaaugggagcaucucccuaaugugucuugcauuaggaggaguacuuauauuuuuaagcacugcaguaagugcggacguagguuguaguguagauuuuagcaaaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9115 - RNA, 2356 nt, Artificial Sequence
  ZIKV prME variant mRNA Design 3 opt
gggagaaagcuuaccaugaacgcuagaaaagaaaaaaaacguagaggugccgacacaagcguaggaauuguaggguuauuauuaacaacagcaauggcagcugaaguaacuagaagagguucagcauacuauauguacuuagauagaaaugacgcuggagaagcaauaaguuuuccaacaacauuagguaugaauaaauguuauauacaaauaauggaucuuggucauaugugcgaugccacaaugucguacgaauguccaaugcuagaugaaggagucgaaccagaugauguagauuguugguguaacacaacaagcacuuggguaguguaugguacaugucaucacaaaaaaggagaggcaagaagaaguagacgggcuguuacacuucccagccacucuacgagaaaacuacaaacacgaagucaaacauggcuagaaucaagagaauacacaaaacaccuaauaagaguagaaaauuggauauuuagaaauccaggguucgcucuugcagcagcagcaauagcauggcuauuaggaaguaguacuagucaaaaagugauauaucuaguaaugauacuuuuaauagcgccagccuacagcauaagauguaucggaguaaguaauagagauuuugucgaaggaaugucuggagguacuuggguagacauaguacuagaacacgguggaugcgugacuguaauggcacaggacaaacccacaguagacauugaauuaguaacaacaacaguaucaaacauggcagaaguaagaucauauuguuaugaagcaaguauaagugauauggcaucagauagucgauguccaacacaaggagaagcuuauuuagauaaacaaagugauacgcaauacguauguaaaagaacgcuaguagacagggguuggggaaacggaugugguuuauucgguaaggguucauuaguaacaugugccaaauuugcauguaguaaaaaaaugacuggaaaaucuauacaaccugaaaauuuagaauacagaauuauguuaucgguucauggaagccagcacagcggaaugauaguuaaugauacaggacaugaaacggaugaaaauagagcaaaaguagaaauaacaccaaacaguccaagagcagaagcaacauuaggaggauuuggaagcuuaggauuggauugugagccgagaacaggauuagauuuuagcgaucuauacuauuuaacaaugaauaacaaacauugguuaguacauaaagaaugguuucacgauauuccacuaccguggcaugcaggagcagauacagguacaccgcauuggaauaacaaagaggccuuaguugaguucaaagaugcucaugcuaaaagacaaacggucguaguacuaggaucacaagaaggagcaguacacacagcacuagcaggagcucuugaagccgaaauggauggugcgaaaggacgauuaucaaguggacauuuaaaaugcagacuaaaaauggauaaauugagauuaaaaggaguaaguuacagcuuauguacagcugccuuuacuuucacaaaaaucccagcugaaacauuacauggaacaguuacaguugaaguucaauaugcaggaacagaugguccauguaaaguaccagcacaaauggcaguagauaugcaaacauuaacuccaguaggaagauuaauaacugccaauccuguaaucacagaaaguaccgaaaauucaaaaaugauguuagaauuggauccgccauuuggagauucuuauauagucauagguguaggugaaaaaaaaauaacacaucauuggcauagaagugguucaacaauagguaaagcauucgaagcaacaguaaggggagcaaaaagaauggcaguacuaggagauacagcuugggacuuugguagcgucggaggugcuuuaaauagcuuaggaaaagguauucaucaaauauuuggugccgcauuuaaaaguuuauucggagggaugaguugguuuagucaaauacucauuggaacucuuuugauguggcuaggauuaaacacaaaaaauggaaguauuucacuaauguguuuagcauuaggaggaguauuaauauuccuaucuacagcagucucagcugauguaggaugcucagucgacuuuaguaaaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9116 - RNA, 2353 nt, Artificial Sequence
  ZIKV prME variant mRNA Design 3 opt
gggagaaagcuuaccauggcaagaaaagaaaagaaaaggagaggagcagacacaaguguaggaauaguagguuuauuacugacuacggcaauggcagcagaaguuacaagaaggggaagcgcauauuauauguauuuagauagaaaugaugcaggagaagcaauaucauucccaaccacauuaggaaugaacaaauguuacauacaaauaauggaccucggacauaugugcgaugccacaaugucauaugaaugcccgauguuagacgaaggaguagaaccagaugauguagauuguugguguaauacuacuagcacauggguaguauacggaacaugccaucauaagaaaggagaagcucgaagaucuagaagggcuguaacuuuacccucacauucaacacguaaauuacagacaagaagccaaacauggcuagaaucaagggaauauacaaaacacuuaauuagaguagaaaauuggauauucagaaauccaggauucgcguuagcagccgcagcgauagcuugguuauuaggaucaaguacaucucaaaaaguaauauaucuagucaugauacuacuaauagcgccagcuuacaguauaagaugcauaggaguaaguaacagagacuuuguagaaggaaugucaggaggcacauggguagacauaguacuagaacaugguggauguguaacagugauggcacaagacaaaccaacaguagauauagaauuaguaacaacgacaguaagcaauauggcagaaguaaggaguuauuguuaugaagcaucaauuucagauauggcaagcgauucaagaugucccacucaaggugaagcauaucuagauaaacaaagcgauacgcaauauguauguaaaagaacuuuaguagaucgaggcugggguaacggaugcgguuuauuuggaaaagggagcuuagucacaugugcaaaauucgcauguucgaagaaaaugacuggaaaaaguauacaaccugaaaaucuagaauacagaauuauguuaucaguacauggaagucaacauaguggaaugauuguaaacgauacaggucaugaaacggacgaaaaucgcgcaaaaguagaaauaacaccuaauaguccacgagcagaagcuacuuuaggggguuucgggucauuaggauuggacugugaaccaagaacagguuuagacuuuagugaccuauauuacuuaacaaugaacaauaaacacugguugguacacaaagaaugguuucaugacauaccauuacccuggcaugcaggagcagacacuggaacuccacauuggaauaauaaagaagcgcuaguagaauuuaaagaugcacaugcaaaaagacaaacuguaguuguccuaggaucacaagaaggagcaguacauacagcauuagcuggagcauuagaggcagaaauggauggagcaaaaggaagauuauccagugggcaucuaaaaugcagguuaaaaauggauaaacuuaggcuaaaaggaguaucuuacucacuauguaccgcugcauucacauuuacaaaaauuccugcagaaacauuacauggaacagugacaguagaagugcaauaugcuggaacugacgguccauguaaaguuccagcacaaauggcaguagauaugcaaacauuaacuccuguagguagacuuauaacagcaaacccaguaauaacagaaaguacagaaaauucaaaaaugaugcuagaauuagauccaccauucggagauagcuauauagugauuggaguaggugaaaagaaaauuacacaccacuggcacaggagugguaguacaauaggaaaagcguuugaagcaacuguaagaggugcaaaaagaauggcugucuuaggugacacugcaugggauuuugguaguguuggaggagcuuuaaauucacuaggaaaagguauacaccaaauauucggagcagcauuuaaaagucuauuuggcgguauguccugguuuucacaaauauuaauaggaacguuauuaaugugguuaggacuaaacacgaaaaauggaagcauaucauugauguguuuagcucuaggaggaguuuuaauauuucuuucaacagcagucucagcagauguuggauguucaguagacuuuaguaaaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9117 - RNA, 2350 nt, Artificial Sequence
  ZIKV prME variant mRNA Design 3 opt
gggagaaagcuuaccaugagaaaagaaaaaaaaagacgaggagcagacacaucagucggaauuguaggacuacuuuuaacaacagcaauggcagcagagguuacuaggagagguucagccuauuauauguauuuagauagaaacgaugcuggcgaagcaauuaguuuccccacaacauuaggaaugaauaaauguuauauacaaauuauggauuugggucauaugugcgacgcaacaaugaguuaugaaugccccaugcuggaugaaggggucgaaccagacgauguagauuguugguguaacacaacaucaaccuggguaguauacgggacaugucaucacaaaaaaggagaagcgagacgaagcagaagagcaguuacacuaccaagucacucaacacgaaaacuacaaacacgaucacaaacaugguuagaaaguagagaguacacaaaacaucuuauucgaguagagaauuggauauuuaggaauccaggauuugcauuagcagcagcagcaauagcaugguuauuagguucaucaacaagucaaaaaguaauauaccuuguaaugauacuacuuauagcaccugcuuauaguauaagauguauuggaguaucaaauagagacuuugucgaaggaaugaguggaggcacguggguagauauaguauuagaacacggaggauguguaacagucauggcacaagacaaaccuacaguagacaucgaacucgucacuaccacaguaucaaauauggcagaaguaagaucauacuguuaugaagccaguauaagugauauggcaagugacucaagauguccaacacaaggugaagcauaucucgauaaacaauccgauacucaauauguauguaaaagaacauuaguagauagaggauggggcaauggauguggacuuuuuggaaaagggucacuaguaacaugcgcaaaauuugcauguaguaaaaaaaugacagguaaaucaauacaaccagaaaaccuugaauaucgaauaauguuaaguguucauggaagccaacacucgggcaugaucgugaacgacacagggcacgaaaccgaugagaauagagcaaagguagaaauaacaccaaauagcccaagagcagaagcuaccuuaggaggauucggaucauuaggcuuagauugugaaccaagaacaggguuagacuuuucagaucuauacuaucuaaccaugaauaauaaacauuggcuaguucacaaagaaugguuucaugauauaccauuaccauggcacgcaggagcagacacgggaacaccacauuggaacaacaaagaagcauuaguggaauuuaaagaugcacacgcaaaaagacaaacuguugugguacuaggaagucaggaaggagcaguacauacagcauuagcgggagcgcuagaagcagaaauggauggagcaaaaggaagacuaucaucuggucacuuaaaauguagauugaaaauggauaaguuaagauuaaaggggguuagcuauucucuauguacagcggccuucacuuuuacaaaaauuccggcagaaacacugcauggaacaguaacaguagaaguccaguaugcagguacagacggaccauguaaaguacccgcccaaauggcaguagauaugcaaacauugacuccaguaggaagacucauaaccgcuaauccgguuauaacagagaguacagaaaacucaaaaaugaugcuagaacucgauccgccauucggagauucguauauaguuauagguguuggagaaaaaaaaauaacacaccauuggcauagaucaggcuccacaauaggaaaagccuuugaagcuaccguaaggggagcaaaaagaauggcaguauuaggagauacugcaugggauuucggaucaguuggaggagcacuaaauagcuuaggaaaaggaauacaucaaauauuuggagcagcauuuaaaucuuuguuuggaggaaugucaugguucagucaaauauuaauaggaacguuauuaaugugguuaggucugaauaccaaaaauggaagcauuaguuuaauguguuuagcauuaggaggaguauuaauauuucuaucgacagcuguaucagcagauguggguuguucaguagauuuuuccaaaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9118 - RNA, 2347 nt, Artificial Sequence
  ZIKV prME variant mRNA Design 3 opt
gggagaaagcuuaccaugaaagaaaaaaaaagaagaggagcagauacaucaguaggaaucguaggauuacuauugacaacagcuauggcagcagaaguaacaagaagaggaucggcauauuauauguauuuagaucgcaacgaugcuggagaagcaauuucauucccaaccacuuugggaaugaauaaaugcuacauacaaauaauggauuugggacauaugugugacgcgacuaugucauacgaguguccgaugcuagaugaaggaguagaaccugaugacguagauuguugguguaauacuacaagcacuuggguagucuaugguacgugccaucauaaaaaaggugaagcucgaagaagcagaagagcaguuacuuuaccuucacacucaacaagaaaauuacaaacgagaagucaaacaugguuagaaucaagagaauauacaaaacauuuaauaagaguugaaaauuggauauuuagaaauccugguuuugcauuagcugcggcagcaauagccugguuauuaggaucaucaacuagucaaaaaguaauuuauuuaguaaugauuuuauuaauagcaccugcguauaguauaagauguauaggaguaaguaauagagauuuuguagaagguaugucaggaggaacauggguagacauaguauuggaacauggggggugcguaacagucauggcucaagacaaaccaacaguagacauagaauuaguuacaacaacuguauccaauauggcagaaguaagaagcuauuguuacgaagcuucuauaagcgacauggcuucagauucaagauguccuacacaaggugaagcauauuuagacaaacaaagugauacccaauacguaugcaaaagaacauugguggauagaggaugggguaauggaugcggauuauuuggaaagggaucacuaguaacaugugcaaaauuugcauguagcaaaaaaaugacaggaaaaaguauacaaccggaaaaucuagaauauagaauaauguuaucgguacacgguagucaacauucaggaaugauaguaaaugauacaggacaugaaacagaugagaacagagcuaaaguugaaauuacaccgaauucuccaagagcagaagcaacgcuaggaggauuuggaagucuagguuuagauugcgaaccaagaacagguuuagacuucagugacuuauacuacuuaacaaugaacaauaaacauugguuaguacacaaagaaugguuucaugauauaccacuaccauggcaugcaggagcggauacuggaacaccacacuggaacaauaaagaagcauuaguagaauuuaaagaugcacaugcaaaaagacaaacaguaguagugcucgguucacaagaaggagcagugcacacagcauuggccggagcacuagaagcagaaauggauggagcaaaaggaagacuaucaucaggacaucuaaaaugcaggcuaaaaauggauaagcuuagauuaaaaggaguaucauauucacugugcacagcagcuuucacauucaccaaaauuccugcagaaaccuugcacgguaccguaacaguagaaguacaguaugccgggacagauggaccauguaaaguaccagcgcaaauggcggucgauaugcagacucuaacaccagugggaagguuaauaacagcuaaucccgugauaacagaaucaacagaaaauaguaaaaugauguuagaacuagauccuccauuuggagauucauacauaguaauaggaguuggagaaaaaaaaauaacacaucacuggcauaggagcggcucaaccauuggaaaagcauucgaagcuacaguaagaggcgcaaaacguauggcaguauuaggagauacagcaugggauuuuggaucaguuggaggugcauuaaacucacucggaaaaggaauacaucaaauauucggagcugcuuucaaauccuuguucggagguaugaguugguuuucucaaauauuaauaggaacacuauugaugugguuaggauuaaauacaaaaaacggaagcauaucauuaauguguuuagcauuagggggugucuuaauuuucuuaucaacagcagugucagcagaugucggguguagcguugauuuuaguaaaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9119 - RNA, 2344 nt, Artificial Sequence
  ZIKV prME variant mRNA Design 3 opt
gggagaaagcuuaccauggaaaagaaaagaagaggagcagauacaucagugggaauuguagggcuauuauuaacaaccgcaauggcagcagaaguaacaagaaggggaagcgcauacuauauguauuuagaccguaaugacgcuggagaagcgauuuccuuucccacaacauuaggaaugaauaaaugcuacauacaaauaauggacuuaggacauaugugugaugccacaaugucauacgaauguccaaugcuugacgaaggaguagaaccagaugacgucgacuguuggugcaauacaacaucuacuuggguuguuuaugggacuugucaucacaagaaaggagaggccagacgaagucguagagcaguaacuuuaccaagccacucaacaagaaaacuacagacuagaagucaaacgugguuagaaucaagagaauauacaaaacauuuaauacgaguggaaaacuggauauucagaaacccuggauucgcauuggcagcagcugcaauugcaugguuauuaggaucaaguacaucacaaaaaguaauauauuuaguuaugauauuacuaauugcacccgcuuauucaauaagauguauaggaguaucuaacagagauuuuguugaaggcaugagcggaggaacauggguagauauaguauuggaacaugggggaugcguuacaguaauggcacaagauaaaccaacaguggauauagaauuagucacaacaacaguuaguaacauggcagagguacgaucuuauuguuacgaagcaaguauaagugauauggcaucggauaguagauguccuacacaaggagaggcuuauuuagacaaacaaagugauacacaauauguuuguaaaagaacacuuguugauagagguugggguaacgguugcggauuauuugguaaaggcucacugguuacgugugcaaaauucgcauguagcaagaaaaugacuggaaaaaguauacaaccagaaaaucuagaauauagaauaauguuaaguguacacggaagccaacauucaggaaugauaguaaaugacacaggacacgaaacagacgaaaauagagcaaaaguugaaaucacuccuaauucaccaagagcagaagcaacacuaggagguuuuggaucucuaggccucgacugugaaccacgcacaggauuagacuuuucagacuuauacuaucuuacaaugaauaacaaacauuggcuaguacauaaagaaugguuccacgacauuccacuaccauggcacgcaggagcagacacaggaacaccacauuggaacaacaaagaagcacuuguagaauuuaaagaugcccaugccaaaagacaaacaguaguaguauuaggaucacaagaaggcgcuguacauacugcccuagccggcgcacuagaagccgaaauggauggcgcaaaaggaagacuaucaagugggcauuuaaaauguagacuuaaaauggauaaacugcgacuaaaaggaguaucguacucauuauguacggcagcuuuuacauuuaccaaaauaccagcagaaacacuacacggaacuguaacgguggaaguucaauacgcuggcacagauggaccuuguaaaguaccagcacaaauggcaguagacaugcaaacuuuaacaccaguaggaaggcuaauaacagccaacccgguaauaacugaaaguacagaaaauucaaaaaugaugcuagaauuagauccuccguucggagauagcuacauaguaauugguguaggagaaaagaaaauaacccaucauuggcaccgaaguggaucuacaaucggaaaagcauucgaagcaacaguaagaggagccaaaagaauggcuguacuuggggauacagcaugggauuuuggaucaguagggggagcgcucaauaguuuaggaaaaggaauacaucaaauauuuggagcagcuuuuaaaaguuuauuuggaggaaugaguugguucucacaaauauuaauagguacccuacuaaugugguuaggacuuaauacuaaaaauggaaguauaucauugauguguuuagcauuagguggaguucuaauauuuuuaucaacagcaguaagugcagauguagguugcucaguagacuucagcaaaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9120 - RNA, 2341 nt, Artificial Sequence
  ZIKV prME variant mRNA Design 3 opt
gggagaaagcuuaccaugaaaaaaaggagaggagcggauacaucaguaggaauuguaggauuacuguuaacuacugcaauggcagcagaaguuacaagaagaggaagugccuauuauauguauuuggacagaaacgacgcaggagaagcaauaucauuuccaacaacauuaggaaugaauaaauguuauauacaaauaauggauuuaggacauaugugugaugccacaaugucuuaugaauguccuauguuagacgaaggaguagaaccugaugacguugauuguuggugcaacacaacaaguacuuggguaguauauggaacaugccaucacaaaaaaggggaagcaaggagaucaagaagggcaguuacauuaccaucucacucuacgagaaaauuacagacaagaucacaaacgugguuagaaaguagagaauauacaaaacacuugauacgagucgaaaauuggaucuuccggaauccagguuuugcgcuagcagcagcagcaauagcauggcuauuaggaaguucaacaagucaaaaaguaauauacuuagugaugauuuuguuaauugcaccugcguacaguauaagauguauaggagugucuaauagagacuuuguagaaggaaugucaggcggaacauggguagauauuguacuagaacacggaggaugcgugacaguaauggcacaagacaaacccacaguagauauagaauuaguaaccacaacaguaagcaauauggcagaaguaagaagcuauuguuaugaggcaaguauaucagauauggcaagugauucaagauguccaacucagggagaagcuuauuuagauaaacaaagcgacacacaauauguauguaaaagaacacuuguagacagaggauggggaaacgggugcgguuuauuuggaaaagguucauuaguaaccugugcaaaauuugcaugcucuaaaaaaaugacuggaaaaaguauacaacccgaaaauuuagaauauagaauaaugcuaaguguacacggaucacaacauucagggaugauaguaaaugauacgggacaugaaacagaugaaaauagagcaaaaguagaaauaacucccaacaguccaagagcagaagcgacacuagguggguuugguaguuuagggcuggacugcgaaccaagaacggguuuagacuuuucagauuuguauuaucuaacuaugaacaauaaacauugguuaguacauaaagagugguuucacgacauuccgcuuccauggcaugccggugcagacacaggaacaccacauuggaacaauaaagaagcauuaguagaauuuaaagaugcacaugcaaaaagacagaccguaguagucuuaggaagucaagaaggagcgguacacacugcacuagcaggagcacuagaagcagaaauggacggagcaaaaggaagacugucaaguggacaccuaaaauguagguuaaaaauggauaaacuaagauuaaaagguguuucauauucacuauguacagcagcauuuacauuuacgaaaauaccagcagaaacauuacacgguacaguaacaguagaaguacaguaugcaggaacagauggaccuugcaaaguaccugcacagauggcuguagauaugcaaacacuuacaccaguaggcagacuaauaacagcaaauccaguaauuaccgaaaguaccgaaaauucaaaaaugauguuagaacuugauccaccuuuuggagacagcuauauaguaauaggggugggagaaaaaaaaauaacacaccauuggcauagaaguggaaguaccauagggaaagcauuugaagcaacaguuaggggagcaaaaagaauggcgguauuaggggacacagcuugggacuuuggaaguguugguggagcauuaaauucauuaggaaaaggaauacaucaaauauuuggagcagcauuuaaaucauuauuuggagggaugaguugguuuagucaaauauuaauaggaacacuauuaaugugguuaggguuaaauacuaaaaauggcaguauaagcuuaauguguuuagcacuagggggagugcuaauauuucuaaguacagccguaagugcagacgucggaugcaguguugauuuuuccaaaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9121 - RNA, 2338 nt, Artificial Sequence
  ZIKV prME variant mRNA Design 3 opt
gggagaaagcuuaccaugaaaagaagaggugcagacacgaguguuggaauagugggauuguuacuaacaacagcaauggcugcagagguuaccagaagaggaucugcauauuauauguauuuagacagaaacgaugccggugaagcaauaaguuucccaacgacucuaggaaugaauaaaugcuacauacaaauuauggacuuaggacauaugugcgaugcaacaaugagcuaugaaugcccaauguuagaugagggaguagaaccagacgauguagauuguugguguaauacaacaucaacuuggguaguuuacgguacuugccaucauaaaaaaggagaagcaagaagaucaagaagagcaguaacauugccuagucauucaacacgcaaacuccaaacaagaucacaaacaugguuggaaucaagagaauacacaaaacauuuaauaagaguagaaaauuggaucuuucgaaauccaggauuugcacuagcagcagcagcaauagcaugguuauuaggaaguucuacaucacaaaaaguaauauaccuagucaugauacucuugauagccccugcauauucuauaagaugcauaggaguuaguaauagagauuucguugaaggaauguccggaggaacuuggguugauauagucuuagaacacggaggauguguaacuguaauggcacaagauaaaccaacuguagauauagaauuaguuacaacaacaguaucuaauauggcagagguacgaucauacuguuaugaggccaguauaagugauauggcauccgacucacgauguccaacacaaggagaagcuuaccuugauaaacaaagugauacgcaauauguauguaaaagaacauuaguagaucgaggauggggcaauggcugcggauuauuuggcaaaggauccuuaguaacaugugcaaaauucgcauguagcaaaaaaaugacaggaaaaucaauacaaccagaaaauuuagaauauagaauaaugcuaucaguacauggaucacaacauagcggaaugauaguuaacgauaccggacaugaaaccgacgaaaauagagcaaaaguagaaauaacaccaaacagcccaagggcagaagcaacauuaggcggauuuggauccuuagguuuagacugugaaccacgcacugguuuggauuuuagugauuuauacuaccuuacaaugaacaauaaacauugguuaguccacaaagaaugguuucaugauauaccauuaccauggcaugcuggugcagauacugggaccccacauuggaauaauaaagaagcauuaguagaguuuaaagaugcacaugcaaaaagacaaacagucgucguccuagggagucaagaaggagcaguacacacagcacuagcaggagcccuugaagcagaaauggacggagcaaaaggaagauuaaguucaggacauuuaaagugucgccuuaaaauggacaaauuaagacuaaaaggagucaguuauucgcuauguaccgcagcguucacguuuacaaaaauuccggcagaaacucuacaugguacuguuacuguagagguccaauaugcaggcacagacggaccauguaaaguaccagcucaaauggccgucgacaugcaaacacucacuccaguaggaagauuaauaacagcaaauccaguaauuacagaaucaacagaaaauaguaaaaugauguuagaauuggauccacccuuuggagacaguuauauuguaauaggagucggagaaaaaaaaauaacacaucauuggcaucgaucaggaucaacgauaggaaaagcauuugaggcaaccgucagaggagcuaaaagaauggcaguucuaggagacaccgcaugggauuucggaucagucggaggggcacuaaauucucucgguaaagggauacaucaaauauuuggagccgcauuuaaauccuuauucggagguaugaguugguuuucacaaauccuaauaggaacauugcuaauguggcugggacuaaauacgaaaaaugguaguauaucauugaugugcuuagcucuaggagguguauuaaucuuucuuagcacagcaguuucggcagacgucggauguaguguagauuucaguaaaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9122 - RNA, 2335 nt, Artificial Sequence
  ZIKV prME variant mRNA Design 3 opt
gggagaaagcuuaccaugagaagaggagccgacacuucagugggaauuguaggauuauuauuaacaaccgcaauggcagcagaaguuacaagaaggggaucagcauauuauauguaucuugauagaaaugacgcaggugaagccauuaguuuccccacaaccuuagguaugaauaaaugcuauauacaaauaauggauuuaggacauaugugugaugcaaccaugaguuacgaaugcccaauguuagacgaagggguugaacccgaugauguagauugcugguguaacacuacaaguacauggguaguauauggcacaugucaucacaaaaaaggugaagcaagaagaucaagacgagcaguuaccuuaccuagccauaguacacgcaaauuacaaacaagaucacagacuugguuagaaaguagggaauauaccaaacacuuaauaagaguugaaaauuggauauuuagaaaucccggauuugcauuagcagcagcagcaauagcgugguuacuaggcagcucaacuagucaaaaaguaauauaucuaguaaugaucuuauuaauagcuccagcauauucaauaagauguauaggagugagcaauagagauuuuguagaaggaaugaguggagguacauggguagacauaguacuagaacacggaggcuguguaacagucauggcacaagauaaaccaacaguugauaucgaauugguaacaacaacaguaagcaacauggcggaaguaagaagcuacugcuaugaagcuaguauaagcgacauggcaagugauucaagauguccuacacaaggagaagcguaucuagauaaacaaagugauacacaauauguuuguaaaagaacauuaguagauagaggauggggaaauggauguggauuguuugguaaagggucauuggucacuugcgcuaaauuugcauguaguaaaaaaaugacaggaaaaagcauucaaccagaaaaccuagaauauagaauaaugcuuaguguccauggaucacagcauucagguaugauaguaaaugacacaggacaugaaacagacgaaaauagagcaaaaguagaaauaacaccgaacagcccaagagcagaagcuacuuuaggaggauuuggaaguuuaggacuagacugugaaccaagaacaggcuuagauuuuagugacuuauauuauuugacgaugaauaauaaacacugguuaguacacaaagaaugguuccaugauauaccauugccauggcaugcaggugcagauacaggaacaccacacuggaauaacaaagaggcccugguagaguucaaagaugcacaugcaaaaaggcaaacaguuguaguauuaggaucucaagaaggugcaguucacacugcccuagccggagcauuagaagccgaaauggauggagcuaaaggaagauugaguagcggacaucuuaaaugcagauuaaaaauggauaaauuaagacucaaagguguaagcuauaguuuauguacagcagccuuuacauuuacuaaaauacccgcagaaacacuacauggaacaguuacaguugaaguacaauacgcaggaacggaugguccauguaaaguaccugcucaaauggcaguagacaugcagacacuaacgccgguagguagauuaauaacagcgaaucccguuauaacugaaucaacagaaaauucaaaaaugaugcuagaauuagauccaccuuuuggagacagcuauauaguaauaggaguaggagaaaaaaaaauaacacaucacuggcauagaucaggcagcacaauugguaaagcuuuugaagcuacaguucgaggagcaaaaagaauggcaguacuaggagauacagccugggauuuuggaagcguagguggagcuuuaaacucuuugggaaaagguauacaucaaauuuuuggagcugcuuuuaagaguuuguuugguggaaugucgugguuuagucaaauauugauaggcacauuacucaugugguuaggacuaaauacaaaaaacggaucaauaagucuaauguguuuagcacuaggaggaguauuaauauuuuuaucuacagcaguaagcgcagacguuggauguucaguagauuucaguaaaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9123 - RNA, 2332 nt, Artificial Sequence
  ZIKV prME variant mRNA Design 3 opt
gggagaaagcuuaccaugaggggagcagauacaucaguaggaauaguaggauuauuauuaacaacagcaauggcagcagaaguuacaaggaggggaagugccuacuacauguacuuagauagaaacgaugcaggagaagcaauuaguuuuccuacaacauuaggaaugaauaaaugcuauauacaaauaauggacuuaggucauaugugcgacgcaacuaugucuuacgaaugcccaauguuagaugaaggaguagaaccagacgauguagacuguugguguaauaccacaaguacguggguaguauauggaacuugucaucacaagaaaggagaagcaagaagauccaggagagcaguaacuuuaccaucacacucaacgagaaaauuacagacaagaagccaaacaugguuagaaucaagagaauauacaaaacacuuaaucagaguagaaaauuggauauuucgaaauccaggauucgcacuugcggcagcugcuauagcauggcucuuaggaaguucuaccagccaaaaaguaauuuauuuaguaaugauacuuuuaauagcacccgcauauucaauaagguguaucggaguuucuaauagagauuuuguggaaggaaugucaggcggaacuuggguggacaucguuuuagaacacggaggauguguuacaguaauggcucaagauaaaccaacuguagauauagaauuaguaacuacgacagugucaaauauggcagaaguaagaucuuauuguuaugaggcuucaaucagugacauggcaucagauaguagauguccaacacaaggagaagcauauuuagacaaacaaagugacacacaauaugucuguaaaaggacauuaguagacagaggguggggaaauggauguggacucuuuggaaaaggaucucuaguaacuugcgcuaaauuugcauguucaaagaaaaugacaggaaaaucaauacaaccagaaaaucucgaauauagaauuauguuaucaguacauggcucacaacauaguggaaugauaguuaaugauacaggacaugaaacagaugaaaacagagcaaaaguagaaauuacaccuaacucaccuagagccgaagccacacuaggugguuuuggaaguuuaggacuagauugugaaccaaggacaggucuagauuuuagcgacuuauauuauuuaacaaugaauaauaaacauugguugguccauaaagaaugguuccacgauauuccauuaccuuggcaugcaggagcagauacaggaacaccacauuggaauaacaaagaagcauuaguugaauuuaaagaugcacaugcuaaaagacaaacuguaguuguacuuggaucccaagaaggagcaguucauacagcauuagcgggugcacuugaagcagaaauggauggagcaaaagguagacuaucaagcggacaucugaaaugucgacuaaaaauggauaaacugagauugaaaggaguuaguuauaguuuaugcacagcagcauucacauuuacaaaaaucccagcagaaacauuacauggaacaguaacuguagaaguacaauaugccggaacugauggacccuguaaaguucccgcacagauggcgguagacaugcagacauuaacuccaguagguagauuaauaacggcaaauccugucauaacggaaucuacagaaaauucaaaaaugauguuggaauuagacccaccauuuggagauuccuacauaguuauaggagucggugaaaagaaaauaacacaucauuggcacaggagcggaaguaccauugguaaggcuuuugaagcaacaguaagaggagcaaaaagaauggcaguuuugggagauacagcaugggauuucgguaguguuggaggagcucuuaauucuuuaggcaaaggaauacaucaaauauucggagcagcuuuuaaaagucuauucggagggaugaguugguuuagccaaauacuaauuggaacgcuacugaugugguuaggacucaacacuaaaaacgggagcauuaguuuaaugugccuagcauuagguggaguacuaauauuucuaucaacagcaguuucagccgaugucggcuguucaguagauuuuuccaaaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9124 - RNA, 2329 nt, Artificial Sequence
  ZIKV prME variant mRNA Design 3 opt
gggagaaagcuuaccaugggugcagauacaucaguuggaauaguaggacugcuauuaacaacagcaauggcggcagaaguaacaagacggggaucagcuuauuacauguaucuagauagaaaugaugcaggagaagcaauaucauucccaacgacacuaggaaugaacaaauguuacauccaaauaauggaccuaggacauaugugcgacgccacuaugagcuaugaaugcccaaugcuagaugaaggaguagaaccggaugauguugacuguugguguaauacgacaucaacuuggguaguauacggaacuugucaucauaagaaaggagaagcaagacgaaguagacgagcaguaacacuaccaucacacaguacaagaaaauuacaaacaagaagucagacauggcuugaaagcagagaauauacaaaacauuuaauaagaguagaaaauuggauuuuuagaaauccagguuucgccuuagcugcagcugcgauagcauggcucuugggaucuagcacuucacaaaaaguaauauacuuaguaaugauuuuacuaauugcaccagcauauucaaucagauguauuggagucagcaauagggacuuuguagaaggcaugucagguggaacguggguagauaucguacuagaacacggagggugcguaacaguaauggcacaggauaaaccaacgguagacauagaauuaguaacgacaacgguaucaaauauggcagaaguaagaaguuacuguuacgaggcaucuauuagugacauggcuucagacucacgauguccaacacaaggagaagcauauuuagauaaacaaagugauacgcaauacguaugcaaaagaacauuaguagacagagggugggguaauggaugcgguuuauuuggaaaaggaucauuaguaacaugugcaaaauuugcauguucuaagaaaaugacaggaaaaaguauccaaccagagaauuuagaauacaggauuauguuaaguguacacggaucacaacauucagggaugauaguaaaugacacaggacaugaaacugaugaaaaucgagcaaaaguagaaauaacucccaauucaccaagagcugaagcuacauuagggggauuuggaucacuaggacuagauugugaaccgagaacaggauuagauuuuagugauuuauauuauuuaacaaugaacaauaaacacugguuaguacauaaagaaugguuucaugacauaccauuaccguggcacgcaggggcagauacuggaacaccacauuggaauaauaaagaggcacugguugaguucaaagacgcucacgcaaaaagacaaacaguagucguguuaggcucucaggaaggagcaguacauaccgcguuagcaggcgcacuagaagcagaaauggauggcgcuaaaggcagacuuagcagcggacacuugaaaugcagacuaaaaauggacaaauuacgguuaaaaggcgugaguuauucauuauguacagccgcauucacauucacaaaaauaccugcugaaacuuuacaugggacagugacgguagaaguacaguaugcggggacagacggaccuuguaaaguaccugcacaaauggcaguagauaugcaaacuuuaacaccaguaggaagauuaauaacagcaaauccaguaauuacagaaaguacagaaaauaguaaaaugaugcuagaauuagacccaccuuuuggcgacucauauauagucauaggaguaggugaaaagaaaauaacacaccauuggcacaggaguggaucuacaauaggaaaagcauuugaagccacaguaagaggagccaaaagaauggcaguacuaggagacacagcuugggauuuuggaagcgucggaggagcacuaaauaguuuaggaaaaggaauacaucaaauauucggagcagccuucaaaucauuauuuggugguauguccugguuuagucaaauauuaauaggaacauuauuaaugugguuaggacuaaauacuaaaaacgguaguaucucacuuauguguuuagcccuggguggaguauuaauauuuuuaucaaccgcuguaucagcugauguuggauguucaguagauuucucaaaaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9125 - RNA, 2326 nt, Artificial Sequence
  ZIKV prME variant mRNA Design 3 opt
gggagaaagcuuaccauggcagauacauccguaggaauaguaggacuuuuauuaacaacagcaauggcagcggaaguaacaagaagagguucagccuauuacauguauuuggauaggaaugacgcaggagaagcaauuagcuucccuacaacacuugggaugaacaaauguuauauacaaaucauggaccuaggacauaugugugaugcaacuaugaguuacgaauguccaaugcuugaugagggaguagaaccagacgacgucgauuguuggugcaauacuacaaguacuuggguaguauaugguacaugucaucauaaaaaaggagaagcaagacgcucaaggagagcaguaacauuaccuagucacucaacaagaaaacugcaaacacgaagucaaacauggcucgagagccgagaauauacaaaacaucuaauuagaguagagaacuggauauucagaaauccaggauucgccuuagcggcagcagcaauagcaugguuacuaggaaguucaacaucacaaaaaguaauauaucuagucaugauuuuauuaauagcuccugcauauucuauacgauguauaggagucaguaauagggauuuuguagaaggaaugaguggagguaccuggguagauauuguauuagaacacggaggcuguguaacuguuauggcacaagauaaaccuacaguagauauagaacuaguaacgacaacagugagcaacauggcugaagugagaucauauuguuaugaagcuagcauaagcgauauggccagugauucuagauguccaacccaaggagaagcauacuuagauaagcaaucugauacccaauauguaugcaaaagaacacuaguagaccgaggauggggcaauggaugcggucuauucggaaaaggaagcuuagugacaugugcaaaauuugcauguuccaaaaaaaugacaggcaaaagcauacaaccagaaaauuuagaauacaggauaaugcuaucaguacauggaucucaacauagcggaaugauaguaaaugauacaggacacgaaacugacgaaaauagagccaaaguagagaucacacccaacaguccaagagcagaagcaacgcuaggaggauuuggaagccucggauuagauugugaaccaagaacaggacuagauuucagcgaucuuuacuauuuaaccaugaacaacaaacauugguuaguacauaaagagugguuucaugauauaccguuaccuuggcaugcaggagcagauacaggaacaccacacuggaauaauaaagaagcccuuguagaauuuaaagacgcacaugcaaaaagacaaacgguaguuguauuagguagucaagaaggagcaguacauacagcacuagcuggugcauuagaagcagaaauggacggagcaaaaggaagauuaagcagcggacaucuaaagugcagacuaaaaauggauaaacuucgccuaaaaggaguaucauacucauuauguacugccgcuuuuacauucaccaaaauaccugcugaaacuuuacacggaacagucacuguagaaguacaauaugcagguacagaugguccauguaaagugcccgcucaaauggcaguagauaugcaaacacuaacaccuguaggaagauuaauaacagcaaacccuguaauaacagaaucaacagaaaacucgaaaaugaugcucgaacuagacccaccguuuggagauaguuacauuguaauugguguaggagaaaaaaaaauuacacaucauuggcaccguucagggaguacuauaggaaaagcauuugaagcaacuguaagaggagcaaaaagaauggcaguauuaggugauacagccugggacuucgguaguguaggaggagcauugaacucccuaggaaaaggcauucaucaaauauuuggagcagcauuuaaaaguuuauuuggaggaaugucaugguuuagucaaauauuaauaggcacgcuacuuaugugguuaggacuaaauacaaaaaacggaaguauuagccuaaugugcuuagcuuuagggggcguguuaauuuuuuugagcacagcaguuagcgcagacguaggauguaguguugauuuuucaaaaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9126 - RNA, 2323 nt, Artificial Sequence
  ZIKV prME variant mRNA Design 3 opt
gggagaaagcuuaccauggacacuaguguaggaauaguaggucuacuacuaacaacagcaauggcagcagaaguuacucgaagagguagcgcauauuauauguauuuagauagaaaugacgcaggagaagcuauaaguuucccaacaacacuaggaaugaacaaauguuacauucaaauaauggaccugggacauaugugcgaugcaaccaugucuuacgaauguccuaugcuugacgaaggaguagaaccugaugauguugacuguugguguaauacaaccagcacuuggguaguauauggaacaugucaucauaaaaaaggggaagcaagacgaucaagaagggcagugacauugccaagucacucaacuagaaaauuacaaacuagaucacaaacaugguuggaaucaagagaauacacaaaacauuuaauuagaguggaaaauuggauauuccgaaacccaggauucgcauuagcggcagcagcaauagcuugguuauugggaagcucaacgagucaaaagguuauauaccuagugaugauacuauuaauagcuccagcauauuccauaagaugcauaggaguaaguaaccgagacuuuguagaaggaaugaguggaggaacauggguagauauaguauuggaacauggaggauguguaacaguaauggcacaagauaaaccaacaguagauauagaacuaguuacaacaacaguuucaaauauggccgaaguaagaucguacuguuaugaggcuagcauaucagacauggcaucugauucaagauguccaacucaaggcgaagcauacuuagauaaacagagugacacgcaauauguaugcaaaagaacacucguggauagaggaugggguaacggguguggccuguucggcaaagguagucuaguaacaugugcuaaauuugcuuguucaaaaaaaaugacaggaaaaucaauacaaccggaaaaccuagaauacagaauaauguuaaguguccacgggagucaacauucaggaaugauuguuaaugauacaggucaugagacugaugaaaauagagcaaaaguagagaucacaccaaauucaccacgagcagaagcaacacuaggugguuuuggaaguuuaggauuagauugugaaccaagaacaggauuagauuuuucagacuuguauuacuuaacaaugaauaauaaacacugguuaguccacaaagaaugguuucaugauauuccacugccauggcaugcaggagcagauacaggcacaccacacuggaauaacaaagaagcauuaguugaauuuaaagaugcacacgcuaaaagacaaacaguagucguauuaggaagucaagaaggagccguucacacagcacuagcaggugcauuagaagcugaaauggacggagcuaaagguagauuaucaaguggacaccuaaaaugcagacugaaaauggacaaauuaagacuaaaaggaguaaguuauagcuuauguacagcggcauuuacauuuacaaaaauaccggcagaaacauuacaugguacaguaacuguagaaguacaauacgccggaacagauggaccaugcaaaguaccugcucaaauggccgucgauaugcaaacccuaacaccgguuggaagacucauaacagcaaauccaguaauaacagagucaacagaaaauaguaaaaugauguuagaauuagacccaccauuuggugacucguacauagugauaggaguuggugaaaaaaaaauaacacaccauuggcacagaaguggaagcacuauuggaaaagcauuugaagcaacuguuagaggcgcaaaaagaauggcaguucuuggagauacagcaugggauuuuggaaguguuggaggagcauuaaacaguuuaggaaaaggcauacaucaaauuuuuggagcagcuuuuaaaucacuauuuggaggaaugucaugguuuucacaaauauuaauugguacuuuacuaaugugguuaggacuaaauacuaaaaaugguaguauaaguuuaaugugucuagcauuaggcggagucuuaaucuucuuaucaacagcaguaagcgcagacguaggguguaguguagacuucucaaaaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9127 - RNA, 2320 nt, Artificial Sequence
  ZIKV prME variant mRNA Design 3 opt
gggagaaagcuuaccaugaccagcguuggaauaguagguuuacuauuaacaaccgcaauggcagcagaagugacaagaagaggaagugcauacuauauguacuuagaucguaacgaugcaggugaagcuauaucuuuuccaacaacguuaggaaugaauaaauguuacauacaaauaauggacuuaggacauaugugugacgcaacuaugucauaugaauguccaauguuagaugaaggaguugaaccagacgacguagauuguugguguaauacuaccaguacauggguaguauauggaacaugccaucauaaaaaaggagaggcuagaagaaguaggagagcaguaacauuaccaucucauucaacaagaaaacuucaaacacgaucacaaaccuggcuagaaagccgagaauacacaaaacaucuaauacgaguggaaaauuggauauuuagaaauccaggauucgcacuagcugcagccgcuaucgcauggcuacuagguaguucaacaucacaaaaaguaauuuacuuaguaaugauccuacucauugccccggcauauucaauaagaugcaucgggguuagcaacagagacuuuguugaaggcaugucgggaggcacauggguagauauuguacuugagcacggagggugcguaacuguuauggcucaagauaaaccaacaguugacauagaacuaguaacaacaacaguaucaaacauggcggaaguaagaaguuauugcuaugaagcaagcauaucugacauggcaucagauucuagauguccaacacaaggagaagcuuauuuagauaaacaaucagacacacaauacguauguaaaagaacauuaguagacagaggcuggggaaauggauguggauuguuuggaaaaggaucauugguaacaugugccaaauucgcauguaguaaaaaaaugacuggaaaaaguauccaaccagaaaauuuagaauaucgaauuauguuaagcguccaugguucccaacauucagguaugauaguaaacgauacaggacacgagacugaugaaaauagagcaaaaguggaaauaacuccaaauaguccaagagcagaagcaacuuuaggugguuuuggaucccucggauuggauugugaaccaagaaccggauuagacuucagugaucuauacuacuuaacaaugaauaauaaacacuggcuuguccacaaagaaugguuccacgacaucccauuaccauggcacgcaggcgcagauacaggcaccccacauuggaauaauaaagaagcacuaguagaauucaaagacgcacaugcaaaaagacaaacgguaguaguauuaggaagucaagaaggagcuguacauacagcccuagcuggagcacuagaagcagaaauggacggagcaaaagguagauuaaguaguggacaccugaaaugcagauuaaaaauggauaaacuaagguuaaaaggaguuagcuauucuuuauguacugcagcauuuacauucacuaaaauaccagcagaaaccuuacauggaacagugacaguagaaguacaauaugcaggaacugauggaccauguaaaguaccagcacaaauggcaguugauaugcaaacauuaacuccaguagggagacuuauaacagcaaauccaguaauaaccgaaucaacagaaaauagcaaaaugauguuagaauuagacccaccuuucggcgacagcuacauagucauaggaguuggugaaaaaaaaauaacccaucauuggcauagaaguggaagcacaauaggcaaagcauuugaagcaacugucagaggggccaaaagaauggcaguucuaggagauaccgcaugggacuucggaaguguaggaggagcacuaaacaguuuaggaaaaggaauacaucagauauuuggggcagcauucaaaagucuauuugggggcaugagcugguuuucacaaauuuuaauuggaacauuguuaauguggcuaggauuaaauacaaaaaaugguagcauaagcuuaaugugucuagcucuaggaggaguacugauuuuuuuaagcacagcuguuagugcugauguaggguguucuguagauuuuucaaaaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9128 - RNA, 2320 nt, Artificial Sequence
  ZIKV prME variant mRNA Design 3 opt
gggagaaagcuuaccaugacaaguguugguauagugggguuauuauuaacgacugcaauggcagcagcaguaacaagaagaggaucagcuuauuauauguauuuagacagaaaugaugcaggggaagcaaucucauuucccaccacucuagguaugaauaaauguuauauucaaauaauggaucucggucauaugugugaugcuacuaugaguuaugaauguccaauguuagaugaaggaguugaaccagaugaugucgacuguuggugcaauacaacaaguacuuggguaguauauggaaccugucaucauaagaaaggagaagcuagacguaguaggagagcaguaacacuuccaagucauucaacaagaaaacuacaaacuagaagccaaacaugguuagaaaguagagaauauacaaaacaccuaauaagaguagaaaacuggauuuuuagaaacccaggauuugcccuggcagcugcugcuauagccugguuacugggauccaguacaucacaaaaaguaauauacuuaguaaugauauuauugauagcucccgcuuauagcauaagauguauuggcgucucuaauagagauuucguagaagggaugaguggugggacauggguagauauaguauuagaacacggagguugcguaacaguaauggcacaagacaaaccaacaguagauauagaauuagugacaacaacagugagcaauauggcugaaguacgaucauauugcuaugaagcaucaaucucagauauggcuucagacucaagauguccaacgcaaggagaagcauaucuagacaaacaaagugauacacaauacguauguaaaagaacauuaguagauagagguugggguaaugguuguggacuauuuggaaaaggcuccuuaguuacaugugcuaaauucgcuugcuccaagaaaaugacaggaaaaucaauacaaccugaaaaucuugaauacagaauaaugcuaaguguacauggaagccaacauagugggaugauaguaaaugauacgggacaugaaacugaugaaaauagagcaaaaguagaaauaacuccaaauagcccaagagcagaagcaacuuuaggcggauucggcagccuuggauuagauugugaaccaagaacaggcuuagauuuuagcgacuuauauuacuuaacaaugaauaacaaacauugguuaguccauaaagaaugguuucacgauauaccauuaccauggcaugcgggugcugauaccgguacaccacauuggaauaacaaagaagcauugguagaguucaaagacgcacacgcaaaaaggcaaacagucguagucuugggaagccaagaaggagccguacauaccgcauuagcaggagcacuagaagcagaaauggacggagcaaaaggaagauuaagcaguggacauuuaaaaugucgauuaaaaauggauaaacuuagauuaaaaggagucucauauucacuuuguacagcagcauuuacuuuuacaaaaauaccugcagaaacauuacaugggacagugacaguggaaguacaauaugcaggaacagauggaccauguaaaguaccagcucaaauggcuguugauaugcaaacacuaacaccaguaggacgacuaauaacugcuaauccaguaauaacagaaucaacugaaaauagcaaaaugaugcuagaacuugacccgccuuuuggugacaguuauauaguuauaggugucggugaaaagaaaaucacacaucacuggcauaggagugggucaacaauagggaaagcguuugaagcaacagucaggggugcaaaaagaauggcuguacuaggagauacagcaugggauuuuggaaguguaggaggggcauugaauagucuaggaaaagguauacaucaaauauuuggggcagcauuuaaaagucuauuuggcggaaugucaugguuuucacaaauucuaauaggaacuuuacuuauguggcucggauugaauacgaaaaauggaucaaucagcuuaauguguuuagcuuuaggaggugugcuaauauuuuuaaguacagccguaucagccgauguaggauguucuguagauuuuaguaaaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9129 - RNA, 2332 nt, Artificial Sequence
  ZIKV prME variant mRNA Design 3 opt
gggagaaagcuuaccaugagaggagcagauacaaguguugggauaguaggacugcuucuaacuacugcaauggccgcugcgguaacgagacgaggaagugcauauuacauguauuuagacagaaacgaugcaggagaagcuauaaguuuuccaacaacgcuagguaugaacaaaugcuacauacagauaauggaucuaggacacaugugugacgcaacuaugucauacgaaugcccaauguuagaugaagguguagaaccagaugaugucgacuguuggugcaacacaacuucgacauggguaguauauggaacaugucaucauaaaaaaggagaagcacgccgaucaagaagggcagucacauuaccaucacacaguacaaggaaauuacaaacaagaagucaaacauggcuugaaucaagagaauauacaaaacacuuaauuaggguagaaaauuggauuuucagaaauccaggauuugcauuagcagccgcagcaauagcuugguuauuaggaaguaguacaagccaaaaaguaauuuauuuaguuaugauacuuuuaauagcuccagcauauucaauacgauguauagguguaucaaacagagauuuuguugaaggaaugaguggaggaacauggguagauauaguucuagaacauggagguuguguaacaguaauggcacaggacaaaccaacaguagacauagaauuaguaacaacaacaguuucaaauauggcagaaguaagaucuuauuguuacgaagcaaguauaagcgauauggcuagcgauucacgaugucccacacaaggagaagcuuaucuagauaaacaaucagauacacaauacguauguaaacgaacauugguagacagaggauggggaaauggauguggauuauuuggaaaagguagccuaguaacaugcgcaaaauucgccuguaguaaaaaaaugacaggaaaaucaauucaaccagaaaacuuagaauauagaauaaugcuauccguucacggcucgcaacauucagggaugauuguaaaugauacaggacaugaaacagaugaaaacagggcuaagguagaaauaacucccaauucaccaagagcugaagcaacauuaggcggguuuggaucacucggucuagacugugaaccacgaacuggauuagauuuuucagaucucuacuaucugacuaugaauaauaaacauugguuaguccauaaagaaugguuucacgauauaccacuacccuggcaugcaggugcagauacuggaacaccucacuggaauaauaaagaagcucuuguagaguuuaaagaugcacaugcaaaaagacaaacaguaguaguauuaggaagucaagaaggagcaguacacacagcauuagccggugcucuagaagcagaaauggacggagcaaaaggcagacucucaaguggacauuuaaaaugucgauuaaaaauggacaaauuaagguuaaaagguguaaguuacagucuauguacagcugcauuuacauuuacaaaaauaccugcugaaacgcuccauggaacagucacaguugaaguccaauaugccggaaccgauggcccauguaaagucccugcacaaauggcgguagacaugcaaacauuaacaccaguugguagauuaauaaccgcaaauccgguuauaacagaaaguacagaaaauuccaaaaugauguuagaauuagauccaccauuuggagacuccuauauaguaauuggaguaggagaaaaaaaaauaacacaucauuggcacagaucagguucaacaauaggaaaagcguucgaagcgacagugagaggagcaaaaagaauggcuguauuaggagauacagcuugggacuuuggguccguaggcggugcacuuaauucacuuggaaaaggcauacaucaaauuuucggggcggcuuuuaaaucacuuuucggaggaaugucaugguuuucacagauauuaauaggaacauuauuaaugugguuaggacuuaauacaaaaaauggaagcauuaguuuaaugugccuagcgcugggagguguacuuauauuucuuucaaccgcaguaagugcugauguaggguguucuguagacuuuuccaaaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9130 - RNA, 2356 nt, Artificial Sequence
  ZIKV prME variant mRNA Design 3 opt
gggagaaagcuuaccaugagaggacugucaucgagaaaaagaagaagccaugauguccuaacaguucaauuucuaauauuagggauguuacuaaugacgggaggaguaacuagacguggaucagcauauuauauguaccuagauagaaacgaugcuggugaagcaauaucauuuccaacaaccuuaggaaugaauaaauguuacauucaaauuauggauuugggucauaugugcgaugcaaccauguccuaugaauguccaauguuagacgaaggaguggaaccagaugauguagauuguuggugcaauacaacgucaacuuggguaguauauggaacuugucaucauaagaaaggagaagcaagaagaucuagacgagcaguaacauuaccaucacauucaacuagaaaacuacaaacaagaagccaaacaugguuagagaguagagaauacaccaaacaucuaauaaggguugaaaauuggauauuucguaauccugguuucgcauuagcagcagcagcuauagcaugguuauuaggaagcaguacaucacaaaaaguaauauacuuagucaugauauuacuaaucgcaccagccuauucaauaagauguauaggaguuaguaauagagauuuuguggaagguaugagugguggaacauggguugacaucguacuagaacauggaggguguguuacuguaauggcacaagauaaaccgacaguugauaucgaauuagugacaacaacaguaucuaauauggcagaaguaagaagcuauuguuaugaagcuagcauauccgauauggcaucagacagcagaugucccacacagggagaagcauaucuugauaaacagucagacacacaguauguaugcaaaagaacauuaguagacagaggguggggaaacggaugugguuuauuuggaaaaggaucauuaguaaccugugcuaaauuugcaugcagcaagaaaaugacuggcaaaaguauacaaccggaaaaucuagaauaccgaauaaugcucaguguucacggaucacaacauucagguaugauuguaaacgauacuggacaugaaacagaugaaaacagagcaaaagucgaaauaacuccaaacaguccacgagcagaagcuacuuuaggcgguuuuggaucccuuggauuagauugugagccacgaacuggauuagauuucagugauuuauauuauuuaacaaugaauaauaaacacugguuaguacacaaagaaugguuccaugauauaccauuaccuuggcaugcaggagcugauacagggacaccacacuggaauaacaaagaagcccuaguagaauuuaaagaugcacaugcgaaacgacaaacaguuguugucuuaggaucucaagaaggugcaguacauacagcauuagcaggagcccuagaagcagaaauggacggugcuaaagggcgauuaucuagcggacauuuaaaauguagauuaaaaauggauaaauuaagacuaaaagguguuagcuauaguuuauguacagccgcauucacauucacuaaaauaccugcagagacucuacauggaacaguaacuguagaaguacaauaugcagguacugacggaccuugcaaaguuccagcacaaauggcaguugacaugcaaacacuaacuccaguaggaagauuaauaacggcgaacccaguuauaacagaaucaacugaaaauagcaaaaugaugcuugaacuagauccaccauuuggagacucauauauaguaauaggaguaggcgaaaagaaaauaacacaucacuggcauagaagugguagcacuauugguaaagcauuugaagcaacuguaagaggugcaaaaagaauggcaguauugggagauacugcaugggauuuuggaucaguaggcggggcacuaaauucacuugggaaaggaauacaucaaauauuuggagcagcauuuaaaucuuuauuuggaggcaugucaugguucucacaaauauugauuggaacccuacuuauguggcuagguuuaaacacuaaaaauggaucaauuucauugaugugcuuagcauugggaggaguauuaauauucuuaagcacagcaguaagugcagacguaggaugcaguguugacuuuaguaaaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9131 - RNA, 2356 nt, Artificial Sequence
  ZIKV prME variant mRNA Design 3 opt
gggagaaagcuuaccaugagaggauuaaguagcagaaaaagaagaagccaugacguguuaacaguacaauuucugauacugggaaugcuacuaaugacuggagcaguaacuagaagaggaagcgcauauuauauguacuuagauagaaaugaugcuggugaagcuauauccuuuccaaccacauugggaaugaauaaauguuauauacaaauuauggacuuaggacauaugugugaugcuacaaugucauaugaguguccuaugcuagaugaaggaguagaaccagaugacguagauuguugguguaauacaacgucaacauggguaguauauggaacuugucaucauaagaaaggagaagcaagaagaucaaggagagcugugacacuaccuucacauagcacaagaaaacuucaaaccagaagccaaacauggcucgaaucaagagaauauacuaaacaucuaauacguguugaaaauuggauauuuagaaacccaggauucgcacuugccgcagcagcaauagcaugguuauuggguucgaguacaucucagaaaguaauauacuuaguaaugauucuauuaaucgcaccagcauauucaauaagaugcauaggagugagcaaccgagauuuuguugaaggcaugaguggaggaacguggguugauauaguucuggaacacggaggauguguuacaguaauggcacaagacaaaccaacaguagacauagaauuggucaccacaacaguaaguaauauggcagaaguaagaagcuacuguuacgaggccaguauuagugauauggcaucagauuccagauguccuacacaaggagaagcauauuuagacaaacaaucagauacacaauauguauguaaaaggacauuaguugacagaggauggggaaauggaugcggauuauuugguaaaggaucauuagugacaugugcuaaauuugcaugcaguaagaaaaugacaggaaaaagcauacaaccggaaaaucuugaguauaggauaauguuaaguguacacggaucacaacauucuggaaugauuguaaaugauacuggacaugaaacagaugaaaaucgagcaaaaguagaaauaacucccaauucaccaagagcugaggcaacacuaggaggauuugggagcuuaggauuagauugugaaccuaggacuggacuugauuuuagugaucuauauuauuuaacgaugaauaauaaacauuggcuaguacauaaagaaugguuucaugacaucccauuaccauggcaugccggggcagauacaggaacaccacacuggaauaacaaagaagcguugguagaauuuaaagaugcacaugcaaaaagacaaacaguuguaguauuaggaagccaagagggagcaguacauacugcacuugcaggagcauuagaagcagaaauggauggugcaaaaggaagacuaucaucagggcauuuaaaauguagacuuaaaauggauaaauuaagacuaaaaggcguaagcuauucauuauguacagcagcauuuacuuucacaaaaauaccagcagaaacauuacauggaacaguaacaguggaaguacaauaugcgggaacagauggaccauguaaaguuccagcacaaauggcaguugauaugcaaacauuaacaccaguuggaagacuaauaacagcaaauccaguaauaacugaauccacagaaaacucaaaaaugaugcuugaacuagauccaccauuuggagauaguuauauagugauuggcguuggggagaagaaaauaacacaucauuggcauagaucaggaucaacaauaggaaaagcauuugaagcaacuguaagaggagcaaaaagaauggcaguucuaggagauacagcaugggauuuuggaagcguuggaggagcgcuaaauagcuuggggaaagggauucaccaaauauuuggagcugcauuuaaaucauuauuuggaggaaugaguugguuuagccaaauacuaauaggaaccuuauugaugugguuaggauuaaauacuaaaaacggaaguauaaguuuaaugugucuagcacuagggggaguuuuaauauuuuuaaguacagcaguaucagccgauguaggcuguaguguagauuuuucaaaaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9132 - RNA, 2347 nt, Artificial Sequence
  ZIKV prME variant mRNA Design 3 opt
gggagaaagcuuaccaugagaauuauaaaugcaaggaaagagaaaaaaagaagaggugcagauacaagcguugguauaguaggacuacuauuaacaacugcaauggcggcagaaguaacaagacgugguucagcuuauuacauguauuuagauagaaacgaugcuggagaggcaauaucauuuccuacaacuuuaggaaugaauaaaugcuauauacaaauaauggauuuaggacauaugugugacgcaacaaugaguuaugaaugcccuaugcuagaugaaggaguugaacccgacgauguagauuguuggugcaauacuacaaguacauggguuguauauggaacaugucaucacaaaaaaggagaggcuagaagaucaagaagagcaguaacauuaccuucacacagcacacgaaaacuacaaacaagaucacaaacaugguuagaaucaagagaauacacaaaacaucuaauuaggguagaaaauuggaucuuuagaaauccuggcuuugcacuugcagcagcagcaauagcuugguuauuagguagcaguacaucucaaaaaguaauauauuuaguaaugauacuacuaaucgcaccagcauacagcauaaggugcauaggaguaucuaauagggauuuuguagaaggaaugucaggaggaacauggguugacauuguacuagaacauggugguuguguaacaguaauggcgcaagauaaaccaacagucgauauagaacuaguaacaacaaccguaucaaauauggcugaaguuagaucauauuguuaugaagcaucaaucagcgauauggcaucagacagcagaugcccaacucaaggagaagcuuauuuagauaagcaaucagauacucaauacguauguaaaagaacacuagucgauagaggaugggguaacggaugugguuuauucggcaaaggaucauuaguuaccugugccaaauuugcauguucaaaaaaaaugacuggaaaaagcauacaacccgagaauuuagaauauaggauaauguugucuguccauggaucucaacacucagguaugauaguuaaugauacaggacacgaaacagaugaaaauagggcuaaaguagaaauaacacccaauaguccucgagcugaagcaacacucggaggauuuggaagucuaggacuagacugugaaccaagaacaggacuagacuuuagugaucuauauuauuuaacaaugaacaacaaacauuggcuaguacauaaagaaugguuucacgacauaccucuaccuuggcacgcaggcgcugauacaggaacaccacacuggaacaauaaagaagcacuaguugaauuuaaagaugcucacgcaaaaagacaaacagucgucguacuaggaagucaagaaggagcuguacauaccgcgcuagccggcgcuuuagaagccgagauggacggagcaaaaggaagauuaucaucgggacacuuaaaauguagauuaaaaauggacaagcuaagauuaaaaggagucucauauucacuaugcacagcagcauuuacauucacaaaaauuccugcggaaacacuacauggaacaguaacuguugaaguacaauaugcaggaacagauggacccugcaagguuccugcacaaauggcuguagauaugcaaacacuaacaccaguaggaagacuaauaacagcaaacccaguaauaacagaaucuacagaaaauucaaaaaugauguuggaauuagauccaccauuuggggauaguuauauaguaauagguguaggagaaaaaaaaauaacacaucacuggcauagaaguggcuccacgauaggaaaagcauucgaagcaacaguacgaggagcaaaaagaauggcaguacuaggagacacagcaugggauuucggauccguuggaggagcauugaauucauuagguaaagguauccaccaaauauuuggagcggcauuuaaaucguuauucggaggaaugaguugguuuucucaaauccuaauugguacacuacucaugugguuagguuuaaacacaaaaaaugguucaaucucauuaaugugcuuagcgcuuggaggaguacuaauauuucucaguacagcugugagugcugacguagguuguugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9133 - RNA, 2344 nt, Artificial Sequence
  ZIKV prME variant mRNA Design 3 opt
gggagaaagcuuaccaugauuauuaaugcaagaaaagaaaagaaaagaagaggugccgauacaagcguaggaauaguaggacuacuacuuacaacagcaauggcagccgaaguaacaagacgcgguucugcuuauuauauguaucuagacagaaaugaugcuggagaagccauuaguuucccaacaacauuaggaaugaauaaauguuacauacaaauaauggaccuaggacacaugugugacgcaacaaugucauaugaaugcccaauguuagacgaagguguugaaccagacgauguagauuguugguguaauacaacaucaacauggguuguuuauggaacaugccaucauaagaaaggcgaggcuagaagaucaagacgagcagucacauuaccuagucauaguacaagaaaauuacaaacaagaucucagacauggcuugaaucaagagaauauacaaaacacuuaauuagaguugaaaauuggaucuuuagaaacccugguuuugcacuagccgcagcugcaauagcuuggcuauuaggaucaucuacaucacaaaaaguaauauauuuagucaugauucuacuaauagcaccagcauauucaaucagaugcauaggagugagcaauagagauuuuguggaaggcaugucuggagggacauggguagauauuguauuagaacauggagggugcguaacuguuauggcacaggauaaaccaacaguagacauagaauuaguuacaacaacaguuucaaauauggcggaaguuagaaguuacuguuaugaagcaucaauuucagauauggcaucagauaguagauguccaacacaaggggaggcuuauuuagauaaacaaagugacacucaauauguauguaaacgaacauuaguagauagaggauggggcaacgguugugguuuauuuggcaaaggaaguuuaguaacaugugcaaaauuugcguguaguaagaaaaugacaggcaaaucaauacaaccagaaaacuuagaauaucgaaucaugcuuaguguacacggcucacaacauucaggaaugauuguaaaugacacuggacaugagacagaugaaaacagagcaaaaguggaaauuacaccuaacucaccaagagcagaagcuacguuaggagguuucggaucucuuggauuagacugugaaccaagaacaggcuuagacuucucugaucuauauuaucuuacaaugaauaacaaacauugguuaguacauaaagagugguuucaugauauaccauuaccauggcacgcaggagcagauacagggacgccacauuggaacaauaaagaagcucuaguagaauuuaaagaugcacacgcaaaaagacaaacaguaguuguuuuagguucucaagaaggagccguacacacagcacuagcuggagccuuagaagcagaaauggacggggcuaaagguagauuaucaucuggacacuuaaaauguagauuaaaaauggauaaauuaagauuaaaaggaguaaguuauagccuguguacagccgcauuuacuuuuaccaaaauaccagcagaaacauuacaugguacaguaaccguagaagugcaguaugcaggaacagaugggccuuguaaagucccagcucaaauggcaguagauaugcaaacacuuaccccaguaggcagacuuauaacugcaaauccagugauaacagaaucaaccgagaacuccaaaaugaugcuagaacuagauccaccauucggagauaguuauauaguuaucggagucggagaaaagaaaauaacucaucauuggcauagaucagguagcacgauaggaaaagcauuugaagcaacagucagaggugccaaaagaauggcaguauugggagauacagcaugggacuuuggaagugucggaggagcacuaaauagcuuaggaaaaggaauacaucaaauuuucggagcagcauuuaaaucuuuauuuggaggaaugagcugguucucacaaauacuuauaggaacauugcugaugugguuaggacucaauaccaaaaacggaagcauaucauuaaugugucuagcacugggaggugucuuaauauuccuaucgacagcaguaucagcagaugugggauguugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9134 - RNA, 2341 nt, Artificial Sequence
  ZIKV prME variant mRNA Design 3 opt
gggagaaagcuuaccaugaucaacgcaagaaaagaaaaaaaaagacgaggagcagacacaaguguaggaauaguaggauuacuuuugacaacugcaauggcagcggaaguaacaagaagaggaagugcauauuauauguauuuagaccgcaaugaugccggugaagcgauaucauucccaacuacuuuaggaaugaauaaauguuauauacaaauaauggauuuaggacauaugugugaugcaacgaugagcuaugaaugccccauguuagaugaaggaguagaaccagacgauguagacuguugguguaauacaacaaguacauggguaguauauggaacgugucaucacaaaaaaggagaagcaaggagaaguaggagagcaguaaccuuaccaucccauagcacucgaaaauuacaaacaagaagccaaacaugguuagaaagucgagaauauacaaaacauuuaauaagagucgaaaauuggauauuuagaaauccaggauucgcauuagcagcagcugcaauagcauggcuauuagguucaucaacaagucaaaaaguaauauauuuaguaaugauuuuacuaauagcaccagcauauucaauaagauguauuggaguaagcaaccgcgauuuuguagaaggaaugucaggaggaacauggguagacauaguacuagaacauggagggugugucacaguaauggcacaagauaaaccaacgguagauauagaauuaguaacgaccaccguuucuaacauggcugaaguacgaucauauugcuacgaagcaucaauaagcgacauggcaucagauucuagauguccaacucaaggagaagcguauuuggauaaacaauccgauacacaauacguaugcaagaggacucuaguagauagggguuggggaaacggauguggguuauuuggaaaaggaaguuuaguuacaugugcuaaguuugcguguaguaaaaaaaugacaggaaagucaauucaaccagaaaauuuggaauacagaauaauguuaagcguacauggcucacaacacagcggaaugauagugaaugacacaggacaugaaacagaugaaaauagagcaaaaguagaaauaacaccaaauaguccaagagcagaagcgacacuaggagguuuugguucauuaggucuagauugcgaaccucgaacagguuuagacuuuucagaucuguauuauuuaacaaugaacaauaaacauugguuaguccauaaagaaugguuucacgauauaccuuuaccguggcacgccggagcagacacaggaacaccccauuggaauaauaaagaagcacuaguagaguuuaaagacgcucaugcaaaaagacaaacuguaguaguuuuggguagccaagaaggagccguacauacagcauuagcaggagcgcuagaagcagagauggacggcgcuaaaggaagauuauccuccggacauuuaaaaugucgauuaaaaauggauaaauuaagacuaaaaggaguaucauauaguuuaugcaccgcagcuuuuacauuuacaaaaauaccugcagaaacucuacauggaaccguaacaguagaaguucaauaugcaggcacagauggaccauguaaaguuccugcacaaauggcuguagauaugcaaacacucacacccguuggaagauuaauaacagcgaacccaguaauaacugaaagcacagaaaauaguaaaaugauguuagaauuagacccaccauucggagauaguuauauaguaauagguguaggagaaaaaaaaauaacucaccauuggcacagaucagggucaacuauuggaaaagcauuugaggcaacaguaagaggagcgaaacguauggcaguauuaggagacaccgcgugggacuuugguagcguaggaggagcauuaaacucguuaggaaaaggaauccaucagauauucggagcagccuuuaaaagucucuucggaggaaugagcugguucucacaaauuuuaauaggaacauuacuaauguggcuaggauuaaauacaaaaaauggcaguauaucauuaaugugcuuagcucuaggaggaguacuaauauucuuaaguacugcagucucagcugaugugggaugcugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9135 - RNA, 2338 nt, Artificial Sequence
  ZIKV prME variant mRNA Design 3 opt
gggagaaagcuuaccaugaacgcaagaaaagaaaaaaaacgucguggugccgauacaaguguaggaauaguaggauuauuguuaacaacagcaauggcagcagaaguaacacgaagaggaucagcauauuacauguauuuggauagaaaugaugcgggagaagcaauaucauuuccaacuacacuuggaaugaauaaauguuauauucaaauuauggauuuaggacauaugugcgacgcuacaaugucauacgaaugcccgauguuagacgaagggguggaaccagaugacgucgauuguugguguaauacaacgucaacguggguaguauauggaacaugccaucacaaaaaaggcgaagcuagaagaagucguagagcaguaacauuaccaagccauaguacaagaaaauuacaaacacgaucccaaacuugguuagaaucaagggaauacacuaaacauuugauaagaguagaaaauuggauauuuagaaauccggguuucgcccuugcggcagcagcaauagcaugguuacuaggaucuucaacaagucaaaaaguaauauauuuaguaaugauacuuuuaauagcaccagcuuauagcauaagaugcauugguguaaguaauagggacuuuguagaagguaugucagguggaacauggguagauauaguacuagaacauggagguugcguaacaguuauggcacaagauaaaccaacggucgacauagaacuaguuacaacaacaguuagcaauauggcagaaguaagaucauauuguuacgaagcaucuauaagcgacauggcaagugauucuagauguccaacacaaggagaggcauaccuugauaaacaaagugauacucaauauguaugcaaaagaacauuaguagaucgaggauggggaaacggguguggucuauuugguaaaggaucauuaguaacgugugcaaaauuugcauguucgaaaaaaaugacaggaaaaucaauacaaccagaaaacuuagaauauagaauaaugcucagcguacaugguucacaacauucaggaaugauuguaaaugauacaggucaugaaacagaugaaaaccgagcaaaaguagaaauuacuccaaauaguccaagagcugaagcaacacuuggagguuuuggaagucuaggacuagacugcgaaccaagaacuggauuagauuuuucugaucuauacuaucuaacaaugaacaauaagcauugguuaguacauaaagagugguuucaugauauuccacuaccuuggcaugcaggugcugauacaggaaccccacauuggaauaauaaagaagcuuugguagaauuuaaagaugcacaugcaaaaagacaaacuguaguaguauuaggaucacaagaaggagcaguacacaccgcacuagcaggagcuuuagaagcugaaauggauggagccaaaggaagauuauccaguggacauuuaaaaugcagauuaaagauggacaaacuacgacuaaaaggaguaagcuauucauuauguacagcagcauuuacauuuaccaaaauaccugcugaaacucuacacggaacaguaacaguagaaguacaauaugcggguacagauggaccauguaaaguaccagcucaaauggcuguagauaugcagacuuuaacaccgguaggaagauugauaacugcaaauccuguaauaacugaaucaacagaaaauaguaaaaugauguuagaauuagauccaccauucggagauucauacauaguaauuggugucggggaaaaaaaaauaacccaucauuggcauagaucaggaaguacaauaggaaaagcuuuugaagcaacaguaagaggagcaaaaagaauggcggugcucggagauacagcuugggauuuuggcaguguagguggugcacuaaauucauuagguaaaggaauacaucaaauuuuuggagcugcguuuaaaucacuauucggaggaaugucuugguuuucucaaauauuaauugggacuuuguuaaugugguuaggucuaaauacaaaaaaugggucaauaucacuaauguguuuagcacugggaggaguauuaauuuuuuuaaguacagcaguaagcgcagacguaggauguugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9136 - RNA, 2335 nt, Artificial Sequence
  ZIKV prME variant mRNA Design 3 opt
gggagaaagcuuaccauggccagaaaagaaaaaaaaagaagaggagcugauacaucaguaggaauaguaggacuauuguugacaacagcaauggcagcagagguaacaagacgagguagcgcauauuacauguauuuagauagaaacgaugcaggagaagcuauaucauucccaacuacauuaggaaugaacaaaugcuauauacaaauuauggauuuaggacauaugugugaugcaacaaugaguuaugaaugcccuauguuagaugaaggaguagaacccgacgauguugacugcuggugcaauacgacaaguacauggguuguauaugguacaugucaucauaaaaaaggagaagcaagacgaaguagacgcgcagucacauuaccgagccauagcacgcguaaacuacaaacacgaucacaaacuuggcuagagaguagagaauauacuaaacauuuaaucagagucgaaaacuggauauucaggaaucccggauuugcauuagcagcagcagcaaucgcauggcuauuaggcucaaguacuagucaaaaaguaauauauuuaguaaugauauuacuaauugccccagcauacaguauaagauguauagguguaagcaaccgagacuucguagaaggaaugucuggaggaacauggguugacauuguacuagaacacggagguugugucacagugauggcgcaagauaaaccuacaguugauauugaacuaguuacaacaacaguaaguaacauggcugaaguaagaucauacuguuaugaagcaucuauaagugauauggcuagugacagucgauguccaacacaaggcgaagcauacuuagauaaacaaucagauacucaauauguauguaaaagaacacuagucgacagaggguggggaaacggauguggacuauuuggaaaaggaucgcuagugacaugugcaaaauuugcaugcucaaaaaaaaugacaggcaaaucaauacaaccugaaaauuuagaauaccggaucauguuaucaguccaugguucacaacauagcggaaugauagucaaugauacaggacaugaaacggaugaaaacagggcaaaaguagaaauaacuccaaacaguccaagagcagaagccacauugggaggcuuuggaagcuuaggauuagacugcgaaccgcguacaggcuuagauuucuccgaucuuuauuaucuaacuaugaauaauaaacauugguugguacauaaagaaugguuucacgacaucccauuaccuuggcaugcaggagcagauacaggaacaccacauuggaacaauaaggaagcauuaguagaauucaaagacgcacaugcaaaaagacaaacaguaguaguacuaggaucacaagaaggagcaguccauacugcucucgcaggagcguuagaagcagaaauggacggagcaaaagggcguuugagcucaggacauuuaaaaugcagauuaaaaauggauaaauuacgauuaaaaggaguaucuuacucgcuauguaccgcagcuuucacauucacaaaaauaccagcagaaaccuuacaugggacaguaacgguugaagugcaauaugcagggacagauggcccauguaaaguacccgcucaaauggcaguugacaugcaaacucuaacaccaguaggaagauuaauuacagcaaacccaguaauuacagaaaguacugaaaacaguaaaaugauguuggaacuagauccaccauuuggagacagcuauauaguuaucggcguaggugaaaaaaaaauaacacaucauuggcauagaagugguaguacgauaggaaaagcuuucgaagcuacgguaagaggagcaaaaagaauggcagucuugggagauaccgcaugggauuuugguaguguugguggugcauuaaauucauuagguaaaggaauacaccaaauauuuggagcagcauucaaaucuuuauucggagguaugaguugguuuucacaaauauugauaggaacauuacuaauguggcuaggcuuaaauacaaaaaaugguuccauaaguuuaauguguuuagcauuaggggguguguuaauauuuuuaucuacugcaguuagugcugauguaggcuguugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9137 - RNA, 2332 nt, Artificial Sequence
  ZIKV prME variant mRNA Design 3 opt
gggagaaagcuuaccaugagaaaagaaaagaaaagaagaggugcagacacuucaguaggaauugugggauugcuacuuacaacugcaauggcagcagaaguaacacgacguggaucugcauacuauauguacuuagacaggaaugacgcuggugaagcaauaaguuuuccaacaacauuaggcaugaacaaaugcuacauacaaauaauggaccuaggacauaugugugacgcaaccaugaguuacgaauguccaauguuagaugaaggaguagagcccgaugauguagauugcugguguaauacaacaagcacauggguaguguauggaacaugucaccauaagaaaggugaagcaagaagaucaaggagagcaguaacucuuccaucacauucaacgcgaaaauuacaaacaaggucacaaacaugguuagaaaguagagaauauacgaaacaccucauaagaguagaaaauuggauauucagaaaucccggcuuugcacuagcagcagcagcaauagcaugguuacugggaaguaguacaucacagaaaguaauauauuugguaaugauauuacuuauagccccagcauauucaauuagauguauaggaguuucgaauagagauuucguggaaggcaugaguggaggaacguggguagacauaguuuuagaacauggaggaugugucacagugauggcacaagauaaaccgacaguagauauagaauuagugacaacuacaguaaguaauauggcagaaguuagaaguuauuguuaugaagcauccauaagcgauauggcuucagauucaagauguccgacucaaggagaagcauauuuagauaaacaaagugacacacaauacguauguaaaaggacucuaguagauagaggaugggguaauggauguggguuauuugguaaaggaucuuuagucacaugugcaaaauucgcaugcaguaagaaaaugacaggcaaaaguauccagccagaaaauuuggaauauaggauaaugcuaucaguacacgguucucaacauuccggaaugauugucaaugauacaggucaugaaacagaugaaaacagggcgaaaguggagauuacaccaaacucaccaagagcggaagcaacacuagguggauuugguucauugggauuagauugcgaaccaagaacaggauuagauuuuucagaucuguacuauuuaacuaugaacaacaaacauugguuaguacauaaagaaugguuucaugauauaccauuaccauggcaugcgggagcagauacaggaacgccacacuggaacaacaaagaagcacucguagaauuuaaagacgcacaugcgaaacgacaaacaguaguaguauuaggaagccaggaaggagcaguacauacagcacuagcaggcgcauuagaagcagaaauggauggagcaaaagguagauuaaguaguggacauuuaaaauguagguuaaaaauggauaaacuaagauuaaaaggaguaaguuauaguuuaugcacugccgcauucacauuuaccaaaauaccugcagagacauuacauggcacaguaacaguugaaguacaauacgcaggcacagaugggccaugcaaagugcccgcucaaauggcaguagauaugcaaaccuuaacgccaguuggcagauuaauaacugcaaacccaguuauaacugaaucgacagaaaacagcaaaaugauguuagaacuagauccgccuuuuggagauucauauauaguaauuggaguaggagaaaagaaaauaacacaucacuggcauagaaguggaagcacaauaggaaaagcauuugaagcgacaguaaggggagcgaaaagaauggccguauuaggagauacagcaugggacuucgguaguguaggaggagcuuuaaauagucuaggaaaaggaauacaucaaauauuuggagcagcuuuuaaaucacuauuuggugguaugucaugguuuucacaaauauuaauaggaacauuacuaauguggcuaggccuaaauaccaaaaauggaaguauaaguuuaauguguuuagcauuaggugguguauuaauauuucuaaguaccgcaguaucagcagauguuggauguugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9138 - RNA, 2329 nt, Artificial Sequence
  ZIKV prME variant mRNA Design 3 opt
gggagaaagcuuaccaugaaagaaaagaaaagaagaggugcagauacauccguaggcauaguagguuuguuauuaacaacagcaauggcugccgaagugacuagacguggaagugcauacuacauguauuuagauagaaaugaugcuggagaagcuauuucauuuccuaccacauuaggaaugaauaaauguuacauacaaauaauggaucuaggucacaugugcgaugccacaaugagcuacgaauguccaauguuagaugagggaguagaaccagacgauguugauuguugguguaauacaacaucaacguggguaguuuaugguacaugccaucauaagaaaggagaagcuagaagaucaagacgagcaguaacauuaccaagucacucaacuagaaaacuacaaacaagaagccaaacauggcuagaaagcagagaauauacuaaacaccuuauuagaguagaaaauuggauauuuaggaacccaggauuugcuuuagcggcugcugcaauugcauggcugcuuggaucaaguacaucucagaaagucauauaucugguaaugaucuuauuaauagccccugcauacaguaucaggugcauaggaguaucgaaucgugauuucguagaaggaaugagcgggggaacauggguugacauaguauuagagcauggaggauguguuacaguaauggcacaagauaaaccaacugucgauauagaauuaguaaccaccacaguaagcaacauggcagaaguaagaaguuauuguuaugaagcaucaauaagcgauauggcaucugacucacgauguccaacacaaggggaagcauaucucgauaaacagucagauacucaauauguuuguaaaagaacucuaguagaucgaggcuggggaaacggaugcggucucuucggaaaaggaucauuaguaacaugugcaaaguucgcauguaguaagaaaaugacaggaaaauccauacaaccagaaaauuuagaauauagaauuauguuaagcguacaugguucucaacacucaggaaugauaguaaaugauacaggccaugaaacagacgaaaacagagccaaaguagagauaacaccaaacaguccacgagcugaagcuacauuaggaggguucggaucauuaggacuggauugugaacccagaacuggucuagacuuuucagaccuuuacuauuuaacaaugaauaauaaacauuggcuaguacacaaagaaugguuucacgacauuccguuaccauggcaugcgggugcagauacaggcacaccacauuggaauaauaaagaagcucuaguagaguuuaaagaugcacaugcaaaacgacaaacagucguaguacuagguagucaagaaggagcaguacauacugcauuagcuggagcauuagaagcagaaauggauggagcaaaaggaaggcuaucauccggucaucuaaaauguagacuaaaaauggauaaacugagauuaaagggagucagcuauucauuauguacagcagcauucacauucaccaaaaucccagcagagacuuuacauggaacaguaacagucgaaguacaauaugcagguacagauggaccauguaaaguuccagcacaaauggcuguagauaugcaaacguuaacacccguugguagacuaauaacagcuaacccaguuauuacagaaagcacagaaaauucaaaaaugauguuagagcuagacccaccauucggugauagcuauauugucauaggagucggagaaaagaaaauaacacaccauuggcacagaucaggaucaacaauaggaaaagccuuugaagcuacaguaagaggagcaaaacgaauggccguauuaggugauacagcaugggauuuuggaucaguuggaggagcacuuaacucucuagguaaaggaauacaucaaauauuuggagcagcuuucaaaucucuauuuggugguaugaguugguuuagucaaauauuaauugguacauuacuaaugugguuaggucuaaauacuaaaaaugguucaauaaguuuaauguguuuagcauuaggaggcguuuuaauauuuuuaaguacagcaguaagcgcugacguuggcuguugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9139 - RNA, 2326 nt, Artificial Sequence
  ZIKV prME variant mRNA Design 3 opt
gggagaaagcuuaccauggaaaagaaaagaagaggagcagauacaaguguaggaauuguuggacuauuauuaacuacagccauggcagcagaaguaacgagaagggguagugcuuauuacauguaucuagacaggaaugaugcaggggaagcaauaucuuucccaacuacauuaggcaugaauaaauguuauauucaaauaauggaucuaggacauaugugugaugcaacaaugucauaugaaugcccaauguuagaugaggguguggaacccgaugauguagauugcugguguaauacaacaagcacauggguuguauauggaaccugccaucauaagaaaggagaagcaagaagaucuaggagagcagugacguuaccaagucauuccacaagaaaauuacaaacaagaucgcagacaugguuagaaagcagagaauacacaaaacacuuaauaagaguagaaaauuggauuuucagaaauccagguuuugcauuagcagccgcagcaauagcauggcuccuaggaucaaguacaucucaaaaaguuauauauuuagucaugauacuacuaauugcuccugcauauaguauaagaugcauagguguuaguaauagagauuuuguagaagggaugucaggagguacauggguagauauaguauuagaacauggaggauguguaacuguaauggcacaagacaaaccuacaguagauauagaacucguaacuacaaccguaaguaauauggcagagguaagaucauauuguuacgaagcaucaauaucagauauggcaucagauaguagaugcccuacgcaaggagaagcauaucuagauaaacaaagcgauacucaauauguauguaaacgaacuuuaguagauagaggguggggaaauggauguggacuauuugguaaaggaucuuuaguaacuugugcaaaauuugcuuguucaaagaaaaugacuggaaaaucaauucaaccagaaaauuuagaauaucgaauaauguuaucaguacauggaucgcaacacagcggaaugauaguaaacgauaccggacacgaaacugacgaaaacagagcaaaaguagagauaacacccaauaguccaagagcagaagcuacacuaggaggauuuggcagccuuggacucgacugugagccaagaacgggauuagacuuuagcgaucuauauuacuuaacaaugaauaacaaacauugguuaguccauaaagaaugguuucaugacauuccacuaccauggcacgcuggugcagauacuggaacaccgcacuggaauaauaaagaagcccuaguugaauuuaaagaugcacaugcaaaaagacaaacagucguaguauuagguucucaggaaggagcaguucauacagcauuagccggugcauuagaagcagaaauggauggagcaaaaggaagauuaaguucuggacaucugaaaugucgacuaaaaauggacaaacuaagauuaaaaggaguaucauacucauuauguacagcagcauuuacauucacuaaaauaccagcagaaacauugcacgguacaguaacaguagaagugcaauaugcuggaacugauggcccguguaaaguaccggcacaaauggcuguagauaugcagacauuaacaccaguaggaagauuaauaacagcaaauccuguaauaacagaaagcacagaaaacaguaagaugauguuagaauuagacccacccuucggggacagcuauauaguuauaggaguuggagaaaagaaaauaacacaucacuggcauaggucaggaucaacaauagggaaagcauucgaagcgacuguuagaggagcaaaaagaauggcgguauugggagauacugcaugggauuucggaucaguaggaggagcauugaauagucuaggcaaagguauacaccaaauauucggggcagcauuuaaauccuuauuugguggaaugaguugguuuagucaaauuuuaauaggaacuuuacugaugugguuaggacuaaauacuaaaaauggauccaucucauuaaugugucucgcgcuaggaggaguacuaauuuucuuaucuacagcaguaucagcggacguaggaugcugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9140 - RNA, 2323 nt, Artificial Sequence
  ZIKV prME variant mRNA Design 3 opt
gggagaaagcuuaccaugaaaaaaagaaggggagcugauacaagcgucggaauaguaggacuauuauuaacaacagcaauggcagcagaaguaacacgaagaggcagcgcuuauuauauguauuuagauagaaaugaugcaggugaagccauaucauuuccaacaacucuaggaaugaauaaauguuacauacaaauaauggauuuaggacauaugugugaugcaacaaugaguuaugaaugcccaaugcuggaugaagguguugaaccugaugauguagauuguugguguaauacaacaucaacauggguaguauacggaacaugccaucacaagaaaggagaagcaagaagaucaagaagagcaguaacacuaccaagucacucuacaagaaaauuacaaacaagaagucaaacgugguuagaaucaagagaauauacaaaacacuugauacgaguagaaaacuggaucuuuagaaauccaggauucgcccuugcagccgcugcaauugcaugguuacuagguaguaguacuagucaaaaaguuauauaccuugucaugauauuauuaauagcuccagcauacucaauaagaugcauaggcguaaguaauagagauuuugucgaaggaauguccggaggaacauggguugacauaguauuagaacacggaggauguguaacaguaauggcacaagauaaaccaacuguugauauugaguuaguuacaacuacaguaucaaauauggcagagguacgaaguuauuguuacgaggcaaguauaucugauauggcaucugauucuagauguccaacucaaggagaagcauaucuugacaaacaaucugauacacaauaugucuguaaaagaacauuaguagaucguggaugggggaacggauguggauuauucggaaaaggaucacuaguaaccugugcuaaauuugcauguuccaaaaaaaugacugguaaaucaauccaaccagaaaauuuagaauacaggauaauguuaucaguccacgguagucaacauagcgguaugauaguuaaugauacaggacaugaaacagaugaaaaucgagcaaaaguugaaauaaccccaaauucaccaagagcagaagccacacuagggggcuuuggaucauugggauuagacugcgaaccucgaacaggauuggacuucucugauuuauauuaucuaacgaugaacaauaaacacugguuaguacacaaagaaugguuucacgauauaccucuaccauggcaugcaggugcagacacaggaacaccacauuggaacaauaaagaggcacuaguagaauucaaagaugcgcacgccaaacgacaaacagucguaguuuuagguucacaagaaggagcuguacauacagcuuuagcaggggcguuagaagcagaaauggauggugcgaaaggacguuugucaucuggucauuuaaaaugucgauugaaaauggauaaacuacgacuaaaaggaguaagcuacucacuuuguacugcggcuuuuacauuuacaaaaauaccagcagaaacccugcauggaacuguuacuguagaaguacaauaugcuggcacagacggaccuuguaaaguuccagcccaaauggcaguagauaugcaaacacuaacuccaguaggaagacuuauaacagcaaauccagugauuacagaaucaacagaaaauaguaaaaugauguuagaacucgauccaccauuuggagauagcuacauagucauaggaguaggcgaaaaaaaaauaacacaccauuggcauagaagcggaaguaccauaggaaaggccuuugaagcgacaguaagaggagcuaaacgaauggcaguacuaggggauacggcaugggacuuugguagcguaggaggagcauuaaacucucucggaaaaggaauacaccaaaucuuuggagcugcauuuaaaucauuauuugguggcaugaguugguuuagccaaauccuaauaggaacauuauuaaugugguuagguuuaaacacaaaaaauggauccauuucauugaugugucuggcacuuggaggaguauuaaucuuucuuuccacugcaguaagcgcagauguaggauguugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9141 - RNA, 2320 nt, Artificial Sequence
  ZIKV prME variant mRNA Design 3 opt
gggagaaagcuuaccaugaagcgaagaggagcagauacuucaguaggaauaguaggacuauuauuaacaacagcaauggccgcagaagucacaagaagaggaucagcauacuauauguaccuagauagaaacgaugcuggagaagcaauaucguucccaacaacacuaggaaugaauaaauguuauauucagauaauggaucucggacauaugugcgaugcaacaaugucauaugaauguccaauguuagaugaaggagucgaaccugaugauguagauuguugguguaauacaacaucaacauggguaguauauggaacaugucaucacaaaaagggcgaggcuagaagaucccguagagccgucacauuaccaucgcauaguacaagaaagcuacaaacacguucucagacauggcuagaaaguagagaauauacaaaacauuuaauccgagucgaaaacuggauauuccgcaauccaggguuugcacuagcugccgcagcuauugcauggcugcuagguucaucaacgucacaaaaaguuauauaccuagugaugauauuauuaaucgcaccagcauauaguauuagauguauagguguaaguaauagagacuuuguagaagguaugagcggaggaacaugggucgauauaguauuagaacauggcggaugugugaccguaauggcacaagauaaacccacgguagauauagaauuggucacaacuacuguaucaaauauggcagaaguaagaucauacugcuacgaagcaucaaucucagauauggccucagauuccagauguccgacccaaggagaagcauaucuagacaaacaaucggauacacaauauguauguaaacgaacgcuaguugauagaggauggggaaauggauguggauuauuuggaaaaggaaguuuagucacaugugcaaaauucgcaugcagcaagaaaaugaccggaaaauccauacaaccagaaaaucuagaauauagaauaaugcuaucaguacacggaagccagcauaguggaaugauuguaaaugauaccggacaugaaacugacgaaaauagagcaaaaguagaaauaacaccaaauaguccaagagcagaagcaacauuagggggauucggaucacuagguuuagacugcgaaccacgaaccggauuagauuucagugacuuauacuauuuaacaaugaauaauaaacauugguuaguacacaaagaaugguuucaugacauaccauuaccauggcaugcaggagcagacacaggaacaccacacuggaacaauaaagaagcauuaguagaauuuaaagaugcacaugcaaaacggcaaacaguaguaguauuaggaagucaagaaggcgcuguacacacagcacuagcuggagcauuggaagcagaaauggacggagcaaaaggaagguuaucaaguggacacuuaaaauguagauuaaagauggauaaacuaagacuaaaaggaguaaguuauucauuaugcacagcugcuuuuacauuuacuaaaaucccagcagaaacacugcacgggacaguaacaguugaaguacaauaugcagguacugauggaccauguaaaguaccugcucaaauggcaguugauaugcaaacauuaacaccaguagggagauuaauuacugcaaacccaguaauaacagaaucuacugaaaauucaaaaaugauguuagaauuagauccaccguuuggagauaguuauauaguaauaggaguuggagagaaaaagauaacacaucauuggcacagaagcggaucaacuauaggaaaagcauuugaagccacaguaagaggagcaaaaagaauggcaguguuaggagauacagcaugggauuuuggaucagugggaggugcacuuaauucauuaggaaaagguauucaccaaauauucggagcagccuuuaaaagucuuuucggggguaugaguugguucagccaaauacuaauaggaacacuacuuaugugguuaggauuaaauacuaaaaaugguaguauaucuuuaauguguuuagcauuaggcggaguacugauauuuuuaucaacagcgguuagcgcugacguggguugcugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9142 - RNA, 2317 nt, Artificial Sequence
  ZIKV prME variant mRNA Design 3 opt
gggagaaagcuuaccaugaggcguggcgcagauacaucaguagggauuguaggauuauuauuaacaacagcaauggcagcagaaguuacaagaagaggaagugcauacuacauguauuuagauagaaacgaugccggagaagcaauauccuuuccaacaacauuaggaaugaauaaauguuauauacaaauaauggacuuaggacacaugugugacgcaacuaugucauaugaaugcccaaugcuagaugaaggagucgaaccugaugacguagauugcugguguaauacaacaaguacauggguaguauauggaacaugucaucauaagaaaggcgaagcaagacgaucaaggagagcaguuacacugcccucacacucaacaagaaaacuacaaacaagaucacaaacuugguuagaaucuagagaauauacaaaacaucuuauaagagucgaaaauuggauauuuagaaacccaggauuugcauuagccgcagcagcaauagcaugguuauuagggaguucaacaucacagaaaguuauauauuuaguaaugauauuauuaauugcaccagcauacucaauaagauguauaggaguuucgaauagggauuucguagaaggaaugucgggagguaccuggguagauauaguuuuagaacauggcgguuguguaacaguuauggcacaagauaaaccuacaguagauauagaacuuguaacaacaacaguuagcaacauggcugaaguaagaagcuauuguuacgaagcaucaauaucagacauggcauccgauucaagaugcccgacacaaggagaagcauaucuagauaaacaaucagauacacaauauguaugcaaacgaacucuaguagacagaggcuggggaaacgguugcggacuauucggaaaagguagccuaguaaccugugcuaaauucgcauguucaaagaaaaugacuggaaaaucaauucaaccugaaaacuuagaauauagaauuauguuaagcgugcauggaagccaacauucagguaugauugucaaugauacgggacaugaaacagaugaaaaccgugcaaaaguagaaauaacaccaaauuccccgagggcagaagcaacacuagggggauuuggaucacuaggcuuagauugugaaccuagaacuggauuagauuuuagugaucuauauuaccuaacaaugaacaauaaacauugguuaguucauaaagaaugguuucaugauauuccauuaccguggcacgccggugcagauacagguacgccacacuggaauaacaaagaagcauuaguagaauuuaaagaugcacaugcuaaacgucaaacugucguaguauuagguucacaagaaggagcaguacauacagcauuagcaggagcccuagaagcggaaauggauggagcaaaaggacgccuaucaaguggacacuuaaaaugucgcuuaaaaauggacaagcuaagauuaaaaggagucaguuauucucuaugcacagccgcuuucacauucacgaaaaucccugcggaaacacuucacggaacaguaacuguagaaguucaauacgcagguacagacggcccguguaaaguaccagcccaaauggccguagauaugcaaacauuaacaccaguaggaagacuaauaacugcaaauccaguuauaacagaaucgacagaaaacagcaaaaugauguuagaacuagacccaccauuuggagauucuuacaucguuaucggaguaggagaaaagaaaauuacacaccacuggcauagaaguggaucaacaauuggaaaagcauucgaagcaacgguaagaggagccaaacgaauggcaguuuuaggagacacugcaugggacuucggaagcguaggaggugcauuaaacucguuagggaaaggcauucaucagauauuuggagcagcauucaaaucauuauucggagguaugucaugguuuagucaaauacuaauuggaacuuuacuaaugugguuggguuuaaacacuaaaaacgguaguauaucacuuauguguuuagccuuaggcggaguguuaauauuuuuaucaacagcaguaagcgcugauguagguuguugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9143 - RNA, 2314 nt, Artificial Sequence
  ZIKV prME variant mRNA Design 3 opt
gggagaaagcuuaccaugagaggagcugauacaucaguaggaauuguagguuuauuacuaacaacagcaauggcagcagaaguuacaagaagaggaucagccuauuauauguauuuagaucgaaacgaugccggagaagcaauaaguuuuccaacaacuuuaggaaugaauaaaugcuauauacaaaucauggaucuuggacacaugugugacgcaacaauguccuacgaauguccaauguuagacgaaggaguagaaccugacgacgucgauuguugguguaauaccacaucaacauggguaguuuacgguacaugccaucauaagaaaggagaagcaaggcgaucaaggagagcaguaacauuacccucacauaguacaagaaaauuacagacuagaucacaaacauggcuugaaucgagagaauacacuaaacaccuaauaagaguagaaaacuggauuuuuagaaauccaggauuugccuuagcagcagcagcgauagcauggcuacuugggucuaguacaagucaaaaaguaauuuacuuaguaaugaucuuacuaauugcaccagcauacucaauaagaugcauuggaguaucaaauagagacuuugucgaagguaugagcgguggaacuuggguagacauugucuuggagcacgguggaugcguaacuguaauggcacaagacaaaccaacaguggacauagaauugguaacaacaaccguaaguaauauggcagaaguuagauccuauugcuacgaggcaucaauaagugacauggcaagugauucaagauguccaacacaaggagaggcuuaucucgauaaacaaagugauacccaauauguauguaaaagaacauuaguugacagagguuggggaaauggcuguggacuauucgguaaagggagcuuaguaacaugugcaaaauuugcauguucaaagaaaaugacaggaaaaucuauacaaccagaaaaucuagaauauaggauuauguuaagcguucauggaucgcaacauaguggaaugauugucaaugacacaggacaugaaacugacgaaaaccgagcuaaaguggaaauaacaccaaauucaccacgagcagaagcuacacucggaggcuucggaucacuaggauuggacugugaaccaagaacagguuuagauuucagcgaucuauauuauuuaacuaugaauaauaaacauugguuagugcauaaagaaugguuucaugauauaccauuaccuuggcacgcaggagcagauacaggcacaccacacuggaauaauaaagaagcccuaguagaauuuaaagaugcacacgcuaaaagacaaacaguaguuguacuaggaucacaagaaggugcuguacauacagcacuugccggggcauuagaagcagaaauggauggagcuaaaggaagauuaagcucaggucacuuaaaauguagauuaaaaauggauaaauuaaggcuaaaaggaguaagcuacucuuuauguaccgcagcuuucacauuuacaaaaauaccagcagaaacauuacauggaacaguaacuguagaaguacaauaugcagguacagaugguccauguaaaguaccagcacagauggcaguagauaugcaaacauuaacaccaguagggagauugauaacagcuaauccugucauaacagaaucaacugaaaauagcaaaaugaugcuagaacuagauccaccauucggugauucauauauaguaauaggaguuggagaaaagaaaauaacgcaucacuggcauagaagcgguaguacaauaggaaaagcauuugaggcaacaguaaggggcgcaaaaagaauggcuguauuaggagauacagcaugggauuucggaagcgucgguggagcacuaaauucacuaggaaaagguauucaucaaauauucggagcagcuuuuaaaucuuuguuuggaggaaugaguugguuuucucaaauacuaauuggaacauugcugaugugguuaggacuaaacacuaaaaacggaucaauuagcuuaaugugucuagcucucggagguguauugauauuuuuaucaacagcuguaucagcggacguuggaugcugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9144 - RNA, 2311 nt, Artificial Sequence
  ZIKV prME variant mRNA Design 3 opt
gggagaaagcuuaccaugggagcugauacaagugucggaauagucggacuauuacuaacuacagcuauggcagcggaaguuaccagaagaggcagcgcauauuauauguauuuagauagaaaugaugcaggagaagcaauauccuuuccuaccacucuaggaaugaauaaauguuauauacaaauaauggaccuaggacacaugugcgaugccacuaugaguuacgaaugcccuaugcuugaugaaggagucgaaccugaugauguagauugcugguguaauacaacaaguacauggguaguauacggaacaugccaucauaagaaaggagaggccagaagaucaaggagagcaguaacacuacccucucauucaacaagaaaauuacaaacaagaagccaaacaugguuggaaaguagagaauauacaaaacaucuaauucgaguagaaaauuggauauuuaggaacccaggauuugcacuagcagcagcagcaauugcuugguuacuaggaucaucaacaucacaaaaaguaauauaccuaguaaugauacuauuaauagcaccagcauauaguauaagauguauaggaguaucuaaccgagauuuuguugaaggaaugagcgggggaacauggguagauauaguguuagaacauggaggauguguuaccguaauggcacaagauaaacccacaguggacauagagcuaguuacaacuaccgucucaaauauggcagagguacgaagcuauugcuaugaagcgagcauaagugauauggcaagugauagccgauguccuacccaaggagaagcauaucuagauaaacaaucagacacucaauauguaugcaaacgaacauuaguugacagaggaugggggaauggauguggacuauuugggaaaggaucucuaguaacaugugcaaaauuugcuuguagcaagaaaaugacagguaaaucaauacaaccagaaaauuuagaguaucgaauuaugcuaagugugcauggaucacaacauucggguaugauaguaaaugacacuggacaugaaacugacgaaaauagagcgaaagucgaaauaacaccaaauuccccaagagcggaagcuacucuaggaggcuucggaagucuggguuuagauugugaaccuagaaccggacuagauuucucugauuuauauuauuuaacaaugaauaauaaacauugguuaguacauaaagagugguuucaugauauuccacuaccauggcaugcuggugcggauacaggaacuccacauuggaacaauaaagaagcauuaguugaauuuaaagacgcacaugcuaaacgacaaacagucguaguacuaggaagucaagaaggagcuguucacacagcucuagcaggagcauuagaagcagaaauggauggagcaaaaggaagauuaucaaguggacaucuaaaauguagauuaaaaauggacaaacuuagauuaaaaggaguaucuuauucucuauguacagcugccuuuacauuuacaaaaauaccugcugagacauuacacggaacaguuacaguugaaguucaauaugcaggcacugauggaccauguaaggucccagcucaaauggcaguagauaugcaaacauuaacaccaguuggaagauuaauaaccgcaaauccuguaauaacagaaagcacagaaaauucaaaaaugauguuagagcuagauccaccauuuggagacucauacauaguaauaggaguaggugaaaagaaaauuacacaucauuggcauagaucaggaaguacaauagguaaagcauuugaagcaacaguaagaggagcaaaaagaauggcaguccuuggcgauacugcaugggauuuuggaucaguuggaggagcacuaaacucucuaggcaagggaauacaucaaauauuuggagcagcuuucaaaaguuuauuuggaggaaugucaugguuuucucaaauacuaauaggaacauuacuuaugugguuaggacuaaauacuaaaaacggcaguauaucucuaauguguuuagcauuaggagguguuuuaauauuucuuucuacagccguaucggcagauguuggauguugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9145 - RNA, 2308 nt, Artificial Sequence
  ZIKV prME variant mRNA Design 3 opt
gggagaaagcuuaccauggcugacacaucaguuggaauaguaggacuauuauuaacaaccgcaauggcagcagaaguaaccagaagaggaucagccuauuauauguaucucgauaggaacgacgcaggcgaagcaauaucauuuccuacaacacuagguaugaauaaauguuauauucaaauaauggaucugggacauaugugcgacgcaaccauguccuaugaauguccuauguuagaugaagguguagagccagaugauguugacuguugguguaauacaacuaguacuuggguaguauacggaacaugucaucauaaaaaaggagaggcccgaagaucaaggagagccguaaccuuaccaagucauucaacaagaaaauuacaaacuaggagucagacuuggcuagaaagucgagaauauaccaaacauuuaauacgaguagaaaauuggauuuuucgaaauccaggauuugcacuugcugcugcugcgauugccugguuacuuggaagcucaacaagucaaaaaguaauuuauuuaguuaugauauuauuaauagcaccagcuuacagcauuagauguauaggagugucaaauagagacuuuguagagggcaugaguggagguacguggguagauauaguauuagaacauggaggaugcgugacaguaauggcacaagacaaaccaacgguagauauagaauuaguaacaacuaccguaucgaauauggcagaaguacgaucauauugcuaugaagcaucaauaagugauauggcuuccgacagcagaugcccuacucaaggagaagcauacuuagauaagcaaagugauacccaauauguuugcaaacgcacacuaguagauagaggaugggguaauggaugugguuuauuuggcaaaggaagucugguaacaugugcuaaauuugcaugcucaaaaaaaaugacaggaaaaucaauacaacccgaaaauuuagaauauagaauaauguuaagugugcaugguucacaacauagcggaaugauuguaaaugauacuggacaugaaacagaugaaaauagagcaaaaguagaaauaacaccaaacaguccaagggcggaagccacacuagguggauuugguucauugggacuagacugugaaccgcgaacuggcuuagauuuuagcgauuuauauuauuuaacaaugaauaacaaacauugguuaguacacaaagaaugguuccaugacauuccacuuccauggcacgcuggcgcagauacuggaacaccucacuggaauaacaaagaagcacuaguggaauucaaggacgcacacgcaaaaagacaaacaguaguaguucuaggaucacaagaaggagcaguacauacagcuuuagcgggagcauuagaagcagaaauggauggagcaaaaggaagacuaucaagcggacaucuaaaauguagguuaaaaauggacaaacuaagauuaaaaggagugucauauaguuuauguacagcagcauucacuuuuacaaaaauuccagcugaaacauuacaugguacaguaacaguugaaguucaauaugcuggaacagauggaccauguaaaguaccagcacaaauggcaguagacaugcaaacacuaacacccguuggccggcuaaucacagcaaauccaguaauuacagaaucaacugaaaauucaaaaaugauguuagaauuagauccacccuuuggagauaguuacauaguaauaggcguaggagaaaaaaaaauuacacaucauuggcauagaucugggucaacaauuggaaaagcguuugaagcaacaguaaggggcgcuaaacguauggcaguucuaggagauacggcuugggauuucggcucaguaggaggagcacuaaauucauuaggaaaaggaauacaucaaauuuuuggagcagcauucaaaucauuauuuggaggaaugagcugguucucacaaauuuuaauaggcacauugcuaauguggcuaggauuaaauaccaaaaaugguucaauauccuuaauguguuuagcauuaggaggaguuuuaauauuuuuaaguacagcaguaucagcagacguuggauguugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9146 - RNA, 2305 nt, Artificial Sequence
  ZIKV prME variant mRNA Design 3 opt
gggagaaagcuuaccauggauacaucaguugguauaguaggacuauuguuaacaacagcaauggcggcagaaguaacaagaagaggaucagcguacuacauguaucuagauagaaacgaugcaggugaagcaauaucauucccaacgacccuaggcaugaacaaauguuauauacaaaucauggaucuaggucauaugugugaugcaacaaugucuuaugaaugucccauguuagaugaaggcguagagccugaugacguagacuguugguguaauacaacaaguacauggguaguuuauggaacaugucaucauaaaaaaggagaagcaagaagaagcagacgagcugugacacuaccuucacacaguacaagaaaauuacaaacaagaucacaaaccugguuggaaagcagagaauauacaaaacacuuaauacgaguagagaacuggauuuuuagaaauccagguuucgcauuagcugcagcagcaauagcauggcuauuagguaguucaacaucucaaaaaguaauauauuugguaaugauauuacuaauagcuccagcuuauaguaucagauguaucggcguaucaaauagagacuuuguugaagguaugucaggaggaacaugggucgauauaguucuugaacaugguggauguguaacaguaauggcacaagacaaaccuacaguagauauagaauuaguaaccacaacaguaucaaacauggcugaaguaagaucuuauuguuaugaagcaagcauaucagauauggcaagcgacagcagaugcccaacacaaggagaagcuuaccuagacaaacaaagugauacucaguacguauguaaacggacacuuguggauagagguuggggaaacggauguggauuauuuggaaaaggcaguuuaguaacaugcgcaaaauuugccuguucaaaaaaaaugaccggaaaaucaauacagccagaaaaucuagaauaccguauaauguuaaguguacaugguagucaacauagugggaugaucguaaaugauacaggacaugaaacagacgaaaacagagcgaaaguagaaauuacaccuaauucaccaagagcagaagcaacauuagguggauuuggcucacuuggauuagauugcgaaccaagaacuggacuagauuuuucagauuuauacuauuuaacaaugaauaauaaacauugguuaguucacaaagaaugguuucaugauauaccucuaccuuggcacgcgggagcagacacaggaacaccucacuggaauaauaaagaagcuuuaguugaauuuaaagaugcucacgcaaaacgacaaacuguaguugucuuagguucucaagaaggagcaguacauacugcauuagcaggcgcucuagaggcagagauggauggagcaaaagguagauuaucgaguggacauuugaaaugcagauuaaaaauggacaaauuaagguuaaaaggaguaaguuacucauuauguacagcagcauuuacauuuacaaaaauaccagcagaaacauuacacggaacuguaaccguugaaguacaauaugcagguacagauggaccaugcaaaguaccagcacaaauggccguagacaugcagacauugacuccaguaggaagauuaauaacagcaaauccaguaauaacugaaagcacggaaaauaguaaaaugaugcucgaauuagauccaccauuuggagauaguuacaucguaaucggaguuggcgaaaaaaaaauuacacaccacuggcauagaucugguucaacaauaggaaaagcauucgaagcaacaguacgcggagccaaacgaauggcaguuuuaggagauacagccugggauuuuggcaguguaggaggcgcucucaauagucuuggaaaaggaauacaucaaaucuuuggagcagccuuuaagagucuguucggaggaaugaguugguucucacaaauacuaauagguacguuauuaauguggcuaggauuaaacacaaagaaugguucaauaucuuugaugugucuagcuuuaggaggcguacucaucuuuuugucaacagcaguaucagcugauguaggaugcugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9147 - RNA, 2302 nt, Artificial Sequence
  ZIKV prME variant mRNA Design 3 opt
gggagaaagcuuaccaugacaaguguaggaauuguaggauuacuacuaacaacagcuauggcagcagaaguaacaagaaggggcucagcauauuauauguauuuagauagaaacgaugcuggggaagcaauaagcuucccuacaacauuaggaaugaacaaauguuacauacaaauuauggacuuagggcauaugugugaugccacaaugucuuaugaaugcccaauguuagaugaaggaguagagccugacgauguagacuguugguguaauacaacaucaacuugggugguauauggcacaugucaucauaaaaaaggcgaagcacgaagauccaggagagcuguaacacuaccaucacauaguacaagaaaauuacaaacaaggucucaaacaugguuagaaucucgcgaauauaccaaacaccuuauaagaguagaaaauuggauauucagaaauccaggcuucgcacuagcagcugcagcuauagcaugguuauuaggaucguccacaucacaaaaagucauauauuuaguaaugauacuauuaaucgcaccagcauauucaauaagguguauaggagugucaaacagagauuuuguugaaggaauguccggaggaacauggguggacauaguucuugaacacggaggauguguuacaguuauggcucaagauaaaccaaccguugacauagaauuaguaacaacaacuguaaguaauauggcagaaguaagaaguuacuguuaugaagcaagcauaucagauauggcaucagacucaagaugcccaacacaaggugaagcauauuuggauaaacaaucagauacacaauauguauguaaaagaacacuaguagauagagguugggggaacggauguggauuauuuggaaaaggcagcuuaguaacaugugcaaaauuugcaugcagcaaaaaaaugacaggaaaaucuauacaaccagaaaaucuagaauacagaauaauguugucaguacaugggucacaacauucaggaaugauaguaaacgauaccgggcacgaaacagacgagaaccgagcgaaaguugaaauaacaccaaacagcccaagagcugaagcaacauuagggggauucggcucauuaggacuagauugcgagccaagaacaggauuagacuuuucagaucuguauuauuuaacaaugaacaauaaacauugguuaguucauaaagaaugguuucacgauauuccauuaccauggcaugcgggagcagauaccggaacaccacauuggaauaacaaagaagcuuuaguagaauucaaagacgcacaugcaaaaagacaaacaguuguaguauuagguagccaggaaggggccguacauacagcacuugcaggagcauuagaggcagaaauggauggugcuaaaggcagacuaaguaguggacaucuaaaauguaggcuaaaaauggauaaauugagacucaaaggagucucauauagucuauguaccgcagcauucacauuuacaaaaauaccugcagaaacacuucauggaacaguaacuguugaaguacaauacgcagggacugauggaccauguaaagucccagcacaaauggcaguagauaugcaaacauuaacaccuguugguagguuaauaacagcaaacccugugauaacugaaucuacagaaaacagcaaaaugauguuagaguuagacccaccauuuggagauaguuauauagucauaggaguaggcgaaaaaaaaauaacucaucauuggcacagaucaggcaguacgauagguaaagcauuugaggcaacaguacgcggagcgaaacgaauggcaguacuaggagauacagcaugggauuucggcucaguuggaggagcauuaaauucacuuggaaaaggcauacaccaaauauuuggugcagcauucaaaagccuauuuggaggaaugucaugguuuagucaaauauuaauaggaacauugcuaauguggcuuggauuaaauacaaaaaauggauccauaucacuaaugugccuagcauuaggaggaguauuaauauuccuaucuacggcagugagcgccgauguaggaugcugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9148 - RNA, 2302 nt, Artificial Sequence
  ZIKV prME variant mRNA Design 3 opt
gggagaaagcuuaccaugacuagcguaggaauagucggacuucuauugacaaccgcuauggcagcagcaguuacaagaagaggcuccgcauauuacauguaccuagacagaaaugaugccggagaagccauaagcuuuccaacaacacuaggaaugaauaaauguuacauucaaaucauggaucucggacauaugugugaugcaacaaugaguuaugaauguccaauguuagacgaaggaguagaaccugaugaugucgauugcuggugcaauacaacaucaacaugggucguauauggcacuugccaccauaaaaagggagaagcuaggcguucacgaagagcaguaacacuaccaucccauucaacuagaaaauuacaaacccgaagucaaacuugguuagaauccagagaauauacaaaacacuugauaagaguagaaaauuggauauuuagaaauccagguuucgccuuagcagcugcagcaauugcaugguuacuaggaagcucaacaucacaaaaaguuauauacuuaguaaugauacuauuaauagcuccagcuuacucaauaagauguauaggaguuucaaauagggauuucguagaagggaugucaggagguacaugggucgacauaguauuagaacauggaggaugcguaacaguuauggcucaagauaaaccaacggucgauaucgaacuuguuacaacuacaguaucuaauauggcagaaguaagaaguuauuguuaugaggcaucuauaagugauauggcuagugauaguagauguccaacacaaggugaagcauacuuagauaaacaaucugacacacaauauguuuguaaaagaacacuaguagaccgaggauggggcaacggguguggauuauuuggaaaaggaaguuuaguaacaugcgcaaaauuugcauguucaaaaaaaaugacaggaaaaucgauucaaccugaaaaucuagaauauagaaucaugcuuucaguucacggaucacagcauaguggaaugauaguaaaugauacaggucacgaaacggacgaaaauagagccaaaguagaaauaacuccgaauucaccaagagcggaagccacucuuggcggauuuggaucauuaggauuagauugugaaccaaggacaggacuagauuucucagaucuauauuaccuuacaaugaauaacaaacauugguuaguacacaaagaaugguuucaugauauaccacuaccuuggcacgcaggagcugauacugguacaccacacuggaacaacaaagaagcguuaguagaauuuaaagaugcacaugcaaaaagacaaaccguaguaguacucggaagccaagaaggagcaguacauacagcucuagcuggagcauuagaagcagaaauggacggagcaaaaggaagauuaucuaguggccaccuuaaauguagauuaaaaauggauaaguuaagacucaaagguguaucauacucauuauguacugcugcauuuacauucacgaaaauaccugcagaaacacuacauggaacuguaacuguugaaguccaauaugcagguacagauggaccauguaaaguaccagcacaaauggcugucgauaugcaaacguuaacuccuguaggacgauuaauaacagcaaauccaguuauaacggaauccacagaaaacucaaaaaugauguuagaauuagauccaccauuuggagauucauauauaguuaucgguguuggagaaaaaaaaauaacucaucauuggcauagaagugguucaaccauaggaaaagcauuugaggcaacuguaagaggagcaaaaagaauggcugugcugggagauacagcuugggauuuuggaagugugggcggagcauuaaauagcuuagguaaagguauacaucaaauauuuggagcagcauuuaaaucacuauuugguggaaugucaugguuuagucaaauacugauagguacucuuuugaugugguuaggauuaaauacaaaaaauggaagcauaaguuuaauguguuuagcauuaggaggaguauuaauauuucuaagcacagcaguaucagcugacguaggauguugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9149 - RNA, 2314 nt, Artificial Sequence
  ZIKV prME variant mRNA Design 3 opt
gggagaaagcuuaccaugagaggagcagauaccaguguaggaauaguaggucuauuauuaacaacagcuauggcagcagccguaaccagaagaggaagugcauauuauauguaccuugacaggaaugaugcgggugaagcaauuaguuuuccaacaacacuugggaugaauaaauguuauauucaaauuauggaucuuggucauaugugugaugcaacaaugagcuacgaauguccuaugcucgaugaaggaguagaaccagaugauguagauuguugguguaauacaacgagcacuuggguaguauauggaaccugccaucauaagaaaggggaagcuagaagaaguaggagagcaguaacacugccaucacauucgacaagaaaacuacagacaagaagucaaacaugguuggaaaguagagaauacacaaaacauuuaauuagaguagaaaacuggauauuuagaaauccuggauucgcauuagcagcagccgccauagcuugguuguuaggaaguagcacaagucaaaaagugauauauuuaguuaugauauuacuaauagcuccugcauauaguauaagaugcauaggaguaaguaauagagacuuuguugaagguauguccgggggaacauggguagacauaguacuagaacauggaggauguguuacaguuauggcacaagauaaaccuacaguggauauugaacuuguaacuacaacggucucaaauauggcagaaguacgaucauauuguuacgaagcaaguauaucugauauggcaucugacucaagaugcccaacgcaaggagaagcauaccuugauaaacaaagugauacacaauacguaugcaaaagaacucuaguagacagaggauggggaaauggcuguggauuauucggcaaaggaucucuuguuacaugcgcaaaauuugccugcucgaagaaaaugacaggaaaaaguauucaaccagaaaauuuagaauauagaauaauguuaagugugcacgguucacaacauuccgguaugaucguaaacgauacaggacaugaaacagaugaaaauagagcuaaaguagagauuacaccaaauaguccacgagccgaagcaacacucggcggauuuggcaguuuagguuuagauugcgaaccgagaacagguuuagauuuuucagauuuauauuauuuaaccaugaacaauaaacauugguuaguccauaaagaaugguuucacgacauaccucuaccauggcaugcaggagcagauacagguaccccucauuggaauaauaaagaggcuuuaguagaauuuaaagaugcacacgcaaaaagacaaacagugguuguauuagguagccaagaaggugcaguacauacagcucuagcaggagcauuagaagcggaaauggauggugcaaaaggaagauuaaguucagggcacuuaaaauguagauuaaagauggacaaguuacgauuaaaaggaguaucauauagccuauguacagcggcauuuacauuuacuaaaauaccagcagaaacacuacacggaacaguaacaguugaaguacaauaugcuggaacagauggccccuguaaaguaccagcacaaauggcaguagacaugcaaacacuaaccccaguaggaagauuaauaacagcaaauccgguaauuacugaaucuacugaaaauagcaaaaugaugcuagaauuagauccaccauucggcgacagcuauauagucauaggggugggagaaaagaaaauuacacaucauuggcacagaucaggaaguacuaucgguaaagcauuugaagcaacaguaagaggagcuaaaagaauggcaguacuaggggauacagcaugggacuuuggaagugucgguggagcacuaaauucuuugggaaaagggauacaccaaauauuuggugcagcauuuaaaaguuuauucgguggaaugucuugguucagucagauacuaauuggcacucuuuuaaugugguuaggucuaaauacgaaaaaugggucaauaucucuaaugugucuagcauuaggagguguuuuaaucuucuuaagcacagcaguaucagcagacguaggauguugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9150 - RNA, 2338 nt, Artificial Sequence
  ZIKV prME variant mRNA Design 3 opt
gggagaaagcuuaccaugcgaggacugucaucaagaaaaagaagaucacaugauguacuuacaguacaauucuuaauauuaggaauguuacuaaugacaggaggcguaacaagaagagguagcgccuacuauauguaucuagauagaaaugaugcaggagaagcaaucaguuucccuacaacccuugguaugaauaaaugcuauauacaaauaauggauuuggggcacaugugugacgcuacaaugaguuacgaauguccaauguuagaugaaggagucgaaccagaugauguagauugcugguguaacaccacaucaacaugggugguauacgggacaugccaucauaagaaaggagaagcaagacguucaagacgagcuguaacauuaccaagucauagcacaagaaaauuacaaacuagaucacaaacaugguuagaaucccgagaguacacaaaacaucuaauaagaguggaaaauuggauuuuuagaaauccagguuucgcauuagcugcagccgcuauagccugguuauuagguucaucuacaagucaaaaaguaauauauuuaguaaugauauuacuaauagcaccagcauauucuauaagauguauaggagucucaaauagagauuucguagaagguaugagcggaggaacuuggguagauauuguacuagaacaugguggcuguguaacaguaauggcucaagauaaaccuacaguagauauagaauuaguaacaacgacaguaucaaauauggcagaaguuagaucuuauuguuacgaagcaagcaucucagauauggcaagugacaguagaugcccaacacaaggggaagcauaucuagacaaacaaucagacacucaauauguauguaaaagaacuuuaguugaccgaggauggggaaaugguuguggacuauucgguaaaggaucauuaguuacuugugcgaaauucgccugcagcaagaaaaugacaggaaaaucaauccaaccagaaaacuuagaauacagaauaaugcuaaguguacauggaagccagcacaguggaaugauaguaaaugauacaggccaugaaacagaugaaaauagagcaaaaguagaaauaacaccaaauucaccgagagcugaggcaacacuaggaggauuugggagcuuaggauuagauugugaaccaagaacaggccuagacuuuagcgauuuauauuacuuaacaaugaauaauaaacacuggcuaguacacaaagaaugguuucaugacauaccuuuaccauggcaugcaggagcagacacugguacaccacauuggaacaauaaagaagcauuaguagaauuuaaagacgcccaugcgaaaagacaaacgguaguaguacuaggaagucaagaaggggcaguacauacagcuuuagcuggugcauuagaagcugaaauggauggagcaaaagguagacuauccucaggucacuuaaaauguagacuaaaaauggacaaauuaagguugaaaggaguaucauacaguuuauguacagcagcauuuacauuuacuaaaauaccugcagagacacugcauggaaccguuacaguggaaguacaauacgcaggaacagauggaccauguaaaguaccagcacaaauggcgguagauaugcaaacacuaaccccgguagguagauuaauaacagcaaacccugugauaacagaaagcacugaaaacucaaagaugauguuagaauuagacccaccauucggugauaguuauauaguaauaggagucggagaaaagaaaauaacacaucacuggcauagaagugguucaacaauagguaaagcguucgaagcaacaguucgaggagcaaaaagaauggccguacuaggagauacugcaugggacuuuggaucaguaggaggagcuuuaaacucucuagguaaagguauucaucaaauauucggggcugcuuuuaagagcuuauuuggcggaaugucuugguuuucacaaauauuaauaggaacacuauuaauguggcuaggacuaaauacgaaaaauggaagcauaagucugauguguuuagcacugggaggaguacucaucuuccuaagcacagcaguuucagccgauguaggauguugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9151 - RNA, 2338 nt, Artificial Sequence
  ZIKV prME variant mRNA Design 3 opt
gggagaaagcuuaccaugcgaggacuaucaucaagaaaaagaagaucacaugacguccuuacaguacaauuuuuaauauuaggaauguuauuaaugaccggagcaguaacuagacgaggaucagcauauuacauguaccuagaccgaaaugacgcaggagaagcuauaucauuuccuacaacccuaggaaugaacaaauguuacauacaaauaauggauuuaggacauaugugugaugccacaaugucauaugaauguccaaugcucgaugaaggaguagaaccggaugacgucgauuguuggugcaacacaacuucgacuuggguaguauacgguacuugucaucauaagaaaggagaagcgagacguucaaggagagcagugacacuaccgucucacucaacaagaaaauuacaaacaagaucacaaacgugguuagaaagcagagaauauacaaaacacuuaaucagaguggaaaauuggauauuuaggaacccaggcuucgcuuuagcagcggcagcaauagcaugguuacuaggauccagcacaucacaaaaaguaauauacuugguaaugauauuacuaauugcuccagcauacucaauuagauguauagguguaaguaacagagauuucguugaaggaaugaguggaggaacaugggucgauauaguacuugagcauggcggaugcguaaccguaauggcacaagauaagccaacuguagauauagaacugguuacaacaacagucucuaauauggcagaaguaagaagcuauuguuaugaagcgucaauaucagauauggcgucagacucaagaugccccacccaaggagaagcauaucuagauaaacaaagugacacacaauauguaugcaaaaggacucuaguagauagaggauggggaaauggguguggauuauucggaaaagggucccuaguaacaugcgcaaaauuugccugcucaaagaaaaugacagggaaaucaauucaaccagaaaaccuagaauacagaauaauguuaagcguucauggaagucaacauucggguaugauuguaaacgauacaggacaugaaacugacgaaaauagagcgaaaguugaaauaacaccuaauucaccaagagcagaagcaacucucggaggauucggaagucuuggacuggauugcgaaccacgaacaggguuagauuuuagcgaccuauauuaucuaacgaugaauaacaaacauugguuaguacacaaagaaugguuucaugacaucccacuaccauggcaugcaggagcagacacagguacgccacauuggaauaacaaagaagccuuaguagaauuuaaggaugcacaugcaaaaaggcaaacuguaguugucuuaggaagccaagaaggcgcaguacauacagcauuagcuggagcuuuagaggcugaaauggauggagcaaaagguagguuaucaaguggacauuuaaaaugucgauuaaaaauggauaaauuaagguuaaaaggaguaucuuauucauuaugcacagcagcauuuacauuuacaaaaauaccagcagaaacccuacaugguacaguaacaguagaaguccaauaugcaggcacagauggaccaugcaaaguuccagcucaaauggccguagauaugcaaacuuuaacacccguuggaagacuaauaacagcaaauccaguaauaacagaaucaacagaaaauaguaaaaugaugcuagaacuagaucccccauuuggcgauagcuauauagucauaggggucggagaaaagaaaauuacacaucacuggcaucgaucaggcaguacaauagguaaagcauuugaagcaacaguacgaggagcuaaaagaauggcaguccuaggagauacagcuugggacuuugguucaguaggaggagcauuaaacucauuaggaaaagguauacaucaaauauuuggagcagcuuucaaaucauuauuuggaggcaugucuugguuuagucagauacuaauaggaacucuauuaaugugguuaggcuuaaauacuaaaaauggaagcauaucuuuaaugugucuagcuuuagguggaguauuaauauuuuuaagcacagcuguaucagcugauguaggcuguugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9152 - RNA, 2338 nt, Artificial Sequence
  ZIKV prME variant mRNA Design 3 opt
gggagaaagcuuaccaugaggauaauaaaugcccgcaaagaaaagaaacggagaggagccgauacaucuguagguauuguaggauuauuauuaacaacagcgauggcagcagaaguaacaagaagaggaucagcuuauuauauguauuuagacagaaacgaugcaggagaagcaauuagcuuuccaacuacauuagguaugaauaaauguuauauacaaauaauggauuuaggacauaugugugaugcgacaauguccuaugaauguccaaugcuagaugaagguguagagccagaugauguagauugcugguguaauacaacaucaacaugggucguauauggaacaugccaucauaagaaaggugaagcaaggcguaguaggagagcaguuacauuaccaucucauucuacuagaaaacuacaaacaagaucacaaacaugguuagaaagucgagaauauacuaaacauuuaauaagaguagaaaacuggauuuuuagaaacccaggauuugcacuagcugcagcugcaauagcaugguuguugggaagcaguacaagucagaaaguaauuuauuuaguaaugauauuauuaauugcaccagcauauucaauuagauguauagguguaucuaacagagacuuuguagagggcaugucaggaggaacauggguugauauuguuuuagaacaugguggauguguaacuguaauggcucaagauaaaccaacaguagacaucgaauuagugacuacaacaguaucaaacauggcugagguuagauccuauuguuaugaagccucaaucagcgauauggccagugauaguagauguccaacacaaggugaagcauauuuagauaaacaaagugauacgcaauauguuuguaaaaggacguuaguagaucggggcuggggaaacggaugcggcuuauuuggaaaaggaaguuuaguaacaugugcaaaauuugcaugcucaaagaaaaugacagguaaaagcauucagccugaaaauuuagaauauagaauaaugcuaaguguacauggcagucaacauucaggaaugauuguaaaugacacgggacacgaaacagacgaaaacagagcaaaagucgaaauaacgccuaauaguccaagagcagaagcaacuuuagguggauuuggaagccuuggacuagauugugaaccacgaacugguuuggauuucagugauuuauacuauuuaacuaugaauaacaaacacugguuaguacauaaagaaugguuucaugacaucccauuaccauggcaugcaggagcggauacugggacaccacauuggaacaauaaagaggcguuagucgaguucaaagaugcacaugcgaaacgacagacaguaguaguauugggaagucaagaaggagccguacacacagcauuagcuggagcauuagaagcugaaauggacggagcaaaaggaagauuaucaucuggacacuugaaauguagauuaaaaauggauaaacucagacugaaaggaguaagcuacagucuauguacagcagcauucacauuuacaaaaauuccugcagaaacacuacauggaacaguuacaguagaaguacaauaugcaggaacagauggaccauguaaaguaccggcacaaauggcuguagacaugcaaacacuuacgccuguaggaagguuaauuacagcaaacccugugauaacagaaaguacggaaaauucaaaaaugauguuagaacuagacccuccauucggugauaguuauauagucauaggaguaggugaaaagaaaauuacacaccauuggcaucgcucaggcucaacaauaggaaaagcguuugaagcgacaguaaggggagcaaaaagaauggcaguguuaggggauacagcaugggauuucggaucgguaggaggugcauugaauagucuaggaaaagguauucaccaaauauuuggagcagcguucaaaucauuauuuggggguaugaguugguucucacaaauauuaauagggaccuuauuaauguggcuaggacuaaauacgaaaaaugguucaauuagucucauguguuuagcauuagguggaguauugauauuccuaaguacagcaguauccgcagauugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9153 - RNA, 2335 nt, Artificial Sequence
  ZIKV prME variant mRNA Design 3 opt
gggagaaagcuuaccaugauaauuaacgcaagaaaagaaaaaaagagaaggggggcagacacaucuguaggaaucguaggguuauuauuaacaacagcuauggcagccgaaguaacgcgaagaggaucagcuuauuauauguauuuagacagaaacgaugcaggagaagcaauaaguuuuccaacuacucuaggaaugaauaaauguuacauacaaauaauggauuuaggacacaugugugacgcaacaaugagcuaugaaugcccaauguuggaugaaggcguagagcccgaugauguggauuguugguguaauacaacaagcacuugggugguauauggcacuugccaucacaaaaaaggcgaagcaagaaggucuagaagagcaguaacauuaccaucccacucaacaagaaaauuacaaacaagaucccaaacauggcuagaaucuagagaauauacaaaacauuuaauucgcguagaaaauuggauauucagaaauccgggguuugcacuagcagcagcugcaauagcauggcuauuaggaucaucgacaagccaaaaaguaauauauuuaguaaugauacuacucauagcaccugcauacucaauaagauguaucgguguaucaaauagagauuucguggaaggcaugagugguggaacauggguugacauaguuuuagaacauggagguuguguuacuguaauggcucaagauaaaccaacaguagauauagaacucguaacaacaacaguuucaaauauggcggaaguaagaaguuauuguuaugaagcuucuauuucagauauggccagcgacagucguugcccaacacaaggugaagcauaucuagacaagcaaagugauacucaauauguaugcaaaagaacacuaguagacagagguugggguaauggaugugguuuauuuggaaaaggaagccuaguaacaugcgcaaaauuugcuugcaguaaaaaaaugacagggaaaaguauacagcccgaaaaccucgaguauagaauaauguuaucuguacauggaucacaacacagcggaaugauaguaaaugauacaggacacgaaacagaugaaaacagagcaaaagucgaaauaacaccaaauaguccucgagcugaagcuacauuaggaggauucggaucgcuaggguuagauugcgaaccuagaacuggauuagacuuuucugauuuauauuaccugacaaugaacaacaaacacuggcuuguacauaaagaaugguuccaugauauuccauuaccauggcaugccggagcagauacaggaaccccccauuggaauaauaaagaagcauuaguagaauucaaagacgcgcacgcuaaaagacaaacaguaguaguacuaggaucacaagaaggagcuguacauacagcauuggcaggagccuuagaagccgaaauggacggagcaaaaggucgucuuucaagcggacauuugaaauguagacuaaaaauggauaaacucagacuaaaagggguaucauauucacuauguacagcagcauuuacauuuacaaaaauaccagcagaaacauuacaugguacagucacaguagaaguucaauaugcaggaacagaugguccguguaaaguaccugcacaaauggcaguagauaugcagacauuaacaccgguugguagguuaauuaccgcaaauccaguaauaacagaaaguacagaaaauucaaaaaugauguuagaauuagauccaccauuuggagacagcuauauaguaauaggaguaggugaaaaaaaaauaacacaucauuggcauagaaguggaucaacaauaggaaaagcauuugaagcaacggucagaggagcaaaaagaauggccguuuuaggggauacagcaugggauuuuggaaguguagguggagcauuaaacucuuuagguaaaggcauacaucaaauauuuggagcggcuuuuaaaaguuuauucggugguaugucaugguuuagucaaauacuaauaggaacuuuauuaaugugguugggauuaaauacaaaaaacgguucgauuaguuuaaugugcuuagcauuaggcggaguauuaauauucuuaaguacggcgguaagugcugauugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9154 - RNA, 2332 nt, Artificial Sequence
  ZIKV prME variant mRNA Design 3 opt
gggagaaagcuuaccaugauaaaugcaaggaaagaaaaaaaaagaagaggagcagauacauccguuggaauaguuggacugcuauuaacaacagcuauggcagcagagguuacacgaagaggaagcgcauauuauauguaucuagauagaaaugaugcaggagaagcuauaaguuuuccgacaacauuaggaaugaauaaauguuauauacaaauaauggaccuaggacauaugugugaugcaacaaugaguuaugaauguccaauguuggacgaaggaguagaacccgacgacguagauuguugguguaauacaacaagcaccuggguaguauauggcacaugucaccauaagaaaggagaagcaagaagaucacgaagagcgguaacauuaccaucacauucuacacgaaaauuacaaacaaggucacaaacaugguuagaaagcagagaauauacaaaacauuuaauucgaguggaaaauuggauauuuagaaauccaggauuugcacuagccgcagcagcaauagcaugguuacuaggaucaucaacaucacaaaaaguaauauauuuaguaaugauacuacuuauagcaccagccuacucaauuagaugcauuggaguaucuaauagagauuucguagaaggaaugagcggaggaacuuggguggauauuguauuagaacacggaggauguguaacaguaauggcucaagauaagccaacaguagacauagaauuaguaacaacuacaguaaguaauauggccgaggucagaagcuacugcuaugaagcaucaauuucagauauggcaagcgauucaagauguccaacacaaggugaagcuuauuuggacaaacaaagugacacacaauauguaugcaaacgaacacugguagaucgcggauggggaaauggauguggauuauuuggaaaagggucauuaguaacaugugcaaaauucgccuguucaaaaaaaaugacuggaaaauccauucaacccgaaaaucuagaauauagaauaauguuaaguguacauggaucacaacauucugguaugauaguaaaugauacaggucaugaaacagaugaaaaccgcgcaaaaguagaaauaacaccuaacucaccuagagcagaagcaacacuaggaggauuuggaagcuuaggguuggacugugaaccuagaacaggacuggacuuuucugacuuauauuaucuaacaaugaacaauaaacauugguuaguacauaaagaaugguuccaugauauaccauuaccauggcaugcaggagcugauacaggaacaccucacuggaacaauaaagaagcacucguagaauuuaaagaugcccaugcgaaaagacaaacuguaguaguuuuaggaucccaagaaggcgcuguacacacugcacuagcuggggcauuagaagccgaaauggacggugcaaagggacgauuaucauccggacauuugaaaugucguuuaaaaauggacaaauuaagacuaaaaggaguaucguauucacuauguacagcagccuuuacuuuuacaaaaauaccagcagaaacauuacauggaacaguuacaguugaaguacaauaugccggaacagacggaccaugcaaaguuccagcacaaauggcuguagauaugcaaacauuaacuccaguaggcagauugauaacagcaaacccugucauaacagaaucaacugaaaacaguaaaaugaugcuugaacuagaccccccauuuggagacucauacauaguaauagggguaggugaaaaaaaaauaacacaccauuggcauagaaguggauccacaauagguaaagccuuugaagcaacuguacguggagcaaaaagaauggcagucuuaggggauacagcaugggauuuuggaucaguaggaggagcuuuaaacucuuuaggaaaaggaauacaucaaauauuuggagcagcauucaaaucacuuuuuggaggaaugucaugguuuucucaaauucuaaucgggacacuacuuauguggcuaggauuaaauaccaaaaacggcaguauaucacugauguguuuggcauuagguggaguuuuaauauuuuugagcacagcggugucagcagauugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9155 - RNA, 2329 nt, Artificial Sequence
  ZIKV prME variant mRNA Design 3 opt
gggagaaagcuuaccaugaaugcgaggaaagaaaagaaaagaagaggugcagauacaucagucggaauaguaggacuguuauugacaacagcgauggcagcagaaguaacaagaagaggaagcgcauauuauauguacuuagauagaaacgaugcuggugaagcaauaucauuuccuacaacauuaggaaugaacaaauguuauauacaaauaauggauuugggacauaugugugaugcuacaaugaguuaugaauguccaauguuggaugaaggaguagagccagacgauguagauuguugguguaacacaacaucaacauggguaguauaugggacuugucaccauaagaaaggggaagcucgacgaagccguagagcgguaacgcuaccaagccauagcacaagaaaauuacaaacgagaagucaaacuugguuagaaagcagagaauacacaaaacauuuaauaagaguagaaaauuggauauucagaaacccaggguuugcacuagcggcggcugcaauagcauggcuccuaggaucaucaacaucacagaaaguaauauaccuaguaaugauacuacuaauagcuccugcauauaguaucagauguauaggaguaaguaaucgagauuuuguagaagguauguccgguggaacguggguagacauaguacuagaacauggaggauguguaacagucauggcacaagacaaaccgacaguagacauagaauuaguuacgacaacaguaucaaauauggcagaagugagaucuuauuguuacgaagcaagcauaagcgacauggcaagugacagccguuguccaacacaaggagaagcauacuuagauaaacaaagugauacacaauauguauguaaaagaacgcuaguugacaggggcuggggaaacggaugcggcuuauucggaaaaggaucucuaguuacaugugcaaaauuugcauguucaaagaaaaugacaggcaaaucaauacaaccggaaaauuuagaauauaggauaauguuaucagugcaugguucacaacauucaggaaugauaguuaacgauaccggucaugagacagacgaaaauagagcaaaaguagaaauaacacccaacucaccaagagcagaagcaacacuagguggauucgguagcuuaggauuagacugugaaccaaggacaggauuggauuuuagugaccuauauuaccuaacaaugaauaauaaacacuggcuaguacauaaagaaugguuucaugauauaccguuaccuuggcaugcuggugcugauacagggacuccacauuggaauaauaaagaagcauuaguagaauuuaaagaugcgcacgcgaaaagacaaacgguaguaguauuagggucacaggaaggagcaguacauacugcacuagcaggagcauuagaagcagaaauggauggagcuaaaggaagacucagcucagggcacuuaaaaugcagauugaaaauggauaaauuaagacuuaaagguguuaguuauucucucuguacugcagcauuuacuuucacuaaaauaccggcagaaacacuucauggcacaguaacagucgaaguacaguacgcaggaacagaugggccauguaaaguaccagcacaaauggcuguagauaugcaaacguuaacaccuguaggacgauuaauaaccgcaaaccccguaauuacagaaucaacagaaaacucaaaaaugaugcuugaauuagacccaccauucggagauagcuauauaguaauaggagugggagaaaagaaaauaacacaucauuggcauagaagcgguucuacaauagguaaagcauucgaggcaacgguuagaggggcaaaaagaauggcgguauuaggagacacagcuugggauuucggaagcguagguggagcauuaaauucacuuggaaaagguauacaucaaauauuuggagcagcauucaaaaguuuauucggagguaugucaugguuuagucaaauuuugauaggaacauuacugaugugguuaggguuaaauacuaaaaacggaagcauuagcuuaaugugucuugcucuaggaggcguauuaauauucuuaagcacagcaguuagugcagacugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9156 - RNA, 2326 nt, Artificial Sequence
  ZIKV prME variant mRNA Design 3 opt
gggagaaagcuuaccauggcuagaaaagaaaagaaacgaagaggcgcagauacaucaguaggaauaguuggucuauuacuaacaacugcaauggcagcagaaguaaccagaaggggaagugccuauuauauguaucuugauaggaaugaugcuggugaggcaauaucauuuccuacaacucuuggaaugaauaaaugcuacauacaaauaauggauuuaggucauaugugcgaugccacaaugucauacgaaugcccaaugcuagaugaaggaguagaaccugaugauguagacuguuggugcaacacaaccaguacauggguaguauauggaacuugucaucacaagaaaggagaagcaagaagaaguagacgagcaguaacgcuaccaagccacucaacacggaaauuacaaacaagaagccaaacaugguuagaaagcagagaguauacgaaacaccucaucagaguagaaaacuggauauuuagaaacccgggauuugcauuagcagcagcggcaauagcauggcuauuaggaaguuccacaagucaaaaaguuaucuacuuaguaaugauacuuuugauagcaccagcauacucaauuagauguaucgggguuucuaauagagauuuuguagaaggaaugaguggagguacauggguagauauaguauuagaacacggaggaugugucacaguaauggcacaagauaaaccaacaguugacauagaauuagugacaacaacaguaagcaauauggcagaaguacgauccuacuguuacgaagcaaguauaagcgauauggcuagugacucacgauguccuacucaaggugaggcuuaccuagauaaacaaagcgauacgcaguauguaugcaaaagaacauuaguagacaggggaugggguaacggaugcgggcuauuuggaaaaggcucucuuguaacaugugcaaaauucgcuuguaguaagaaaaugacggguaaaucaauacaaccagaaaaucuagaauauagaauaauguuaaguguacauggaucucaacauagugggaugaucguaaaugauacaggucacgaaacagacgaaaacagagcuaaaguagaaauaacaccaaauagcccgagagcagaagcuaccuugggaggauuuggaagccuaggucuugauugugaacccagaacaggauuagauuucucagauuuauauuaccuaaccaugaauaauaaacauuggcugguacauaaagaaugguuucaugauauaccuuuaccauggcacgcgggggcagacaccgguacuccacacuggaauaauaaagaggcauuaguagaauuuaaagacgcacaugcaaaaaggcaaacaguagugguacuagguagccaagaaggagcaguacauaccgcauuagcaggagcacuagaggcugaaauggauggagcaaaaggaagacuaucaucaggacaucuuaaaugucgauuaaaaauggacaaauuaagauuaaaagggguaagcuauaguuuaugcacggcagcuuuuacauuuaccaaaauaccagcagaaaccuuacaugguaccguaaccguugaaguucaauaugcuggaacagacggaccauguaaaguacccgcacaaauggcaguagauaugcaaacacuaacaccaguugggcgacugauaacugcaaauccaguaauaacagagucaacagaaaacucaaagaugauguuagaauuagauccaccauuuggugauucauauauaguaauaggaguuggagaaaagaaaaucacacaucauuggcauagaagcggaaguacuauaggaaaggcuuuugaagcaacaguaagaggagcaaaacgaauggcagucuuaggagauacugcuugggauuucggaaguguaggaggagcuuuaaacagccucgguaaagggauacaucaaauauuuggagcagcauuuaaaaguuuauuuggaggaaugaguugguuuucacaaauauuaauuggcacauuacuuauguggcuagguuuaaauacgaaaaacggaagcauauccuugaugugcuuagcacuuggagggguacuaauauucuugaguacagcaguaagugcagauugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9157 - RNA, 2323 nt, Artificial Sequence
  ZIKV prME variant mRNA Design 3 opt
gggagaaagcuuaccaugagaaaagagaaaaaacgaagaggcgcagauacuaguguaggcaucguaggacuauuauuaacaacugcuauggcagcagaaguuacaagaagaggcagcgcauauuacauguauuuagaccgaaaugacgcaggagaagcuauuucauucccaacaacauuaggaaugaacaaauguuauauacaaauuauggacuuaggccacaugugugaugcaacaaugucauaugaauguccaauguuagaugaaggaguagaaccagaugauguagacuguuggugcaauacaacaaguacauggguaguauacgguacaugucaucauaaaaaaggugaagcaagaagaucuaggagagcaguaaccuuaccaucacauucaacaagaaaauuacagacaagaagucaaacgugguuagaaaguagagaauauacaaaacaucuaauuaggguagaaaauuggauauucagaaauccgggauuugcauuagcagccgcagcaauagcauggcuauuagggucuucaacaagucagaaaguaauuuaccuaguaaugauauuacuaauagcaccggccuacaguauacgguguauaggaguaaguaacagggauuucguugaaggaaugaguggagguacauggguagacauaguauuagaacaugguggauguguaacuguuauggcacaagauaaaccuacaguagacauugaacuaguuacaacaacaguuaguaacauggcagaaguaaggaguuauuguuaugaagcuucaauaagugauauggcaucagauucacguuguccuacacaaggagaagcuuauuuagauaaacaaagugauacacaauacguauguaaaagaacauuaguagaucgaggauggggaaaugguuguggucuauucggcaaagguucuuuaguaaccugugcaaaauuugcuugcagcaaaaaaaugacuggaaaaaguauccaaccagagaacuuagaauauagaauaauguuaaguguacauggaagccaacacucaggaaugauaguaaaugauacaggacaugaaaccgaugagaauagagcuaaaguagaaauaacaccaaacucaccucgagcugaagcaacauuaggaggauucggaucguugggauuagacugugaaccgagaacuggacuagauuuuucugauuuauauuauuuaacaaugaauaauaaacacugguuaguucauaaagaaugguuucaugauauaccauuaccuuggcaugcaggugcugauacuggaacaccacacuggaauaauaaagaagcauuaguagaauuuaaggaugcacacgcgaaaagacaaacaguaguaguuuuaggaagccaagagggagcaguacacacagcucuagcaggagcguuagaagcagaaauggauggugcaaaaggacgauuaucaucaggacaucuuaaaugucgacuaaaaauggacaaacugagacuaaaaggaguaucauauaguuuauguacagcagcguuuacauuuacuaaaauaccugcggaaacacuucauggaacuguuacgguagaaguacaauaugcaggaacugauggaccaugcaaaguaccggcccaaauggcaguagacaugcaaacuuuaacaccagucggaagauuaauaacugcaaaccccguaauaacagaaagcacugaaaacaguaaaaugauguuagaacuugaucccccauucggagauagcuauauaguuauaggcguaggagaaaagaaaauaacacaucauuggcacagaucaggaucaacaauaggaaaagcuuuugaagcuacagugagaggagcaaaaagaauggcaguauugggagauacagcuugggauuucgguucuguuggcggagcgcuaaauagucuaggaaaaggaauacaucaaauauucggugcugcauuuaaaucauuguucggaggcaugucaugguuuagccaaauuuuaauaggaacacuauuaaugugguuaggauuaaacaccaaaaauggcucuauuucacuaaugugcuuagcauuaggagguguauuaauauucuuaaguacagcgguuagugcggacugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9158 - RNA, 2320 nt, Artificial Sequence
  ZIKV prME variant mRNA Design 3 opt
gggagaaagcuuaccaugaaagagaaaaaaagaagaggagcagauacgucaguaggaauuguaggauuauuauugacaacagcaauggcagcugaagugacucguagaggaucagcauacuauauguauuuggaucguaaugacgcaggugaagcaauuucuuuuccuacaacauuagguaugaauaaguguuauauacaaauaauggacuuaggacacaugugugaugcaacaaugucauaugaaugcccuauguuagacgaagggguagaaccagacgauguugauuguugguguaauacuacaucaacauggguaguauacggaacaugucaccauaaaaaaggagaagcacgcagaaguagacgagcaguaacacuaccuucacauucaacaagaaaacuacagacgagaucacaaacuuggcuagaaaguagagaauacacaaaacaucuaauaagaguagaaaauuggaucuuuagaaauccagguuuugcguuagcagcagcagcaauagcuugguuguuagggucgucaacuagccaaaaaguaauauaucuaguaaugauauuauuaaucgcaccggcuuauaguauaagaugcauaggaguuaguaaucgagauuuuguagagggaaugucaggaggaacuuggguagauaucguucuagaacacggaggauguguaacaguaauggcacaggauaaaccaacaguugauauugaauuaguaacaacaacaguaagcaacauggcagaaguaaggaguuauugcuacgaagcuaguauaucagauauggcaagugauucaagauguccuacacaaggugaagcauauuuagauaaacaaagcgacacacaauaugucuguaaaagaacauugguugauagagguuggggaaaugguugcggauuauucggcaaagguucucuaguaacuugcgcaaaauuugcauguucaaaaaaaaugacagguaaaagcauacaaccagaaaacuuagaauauaggauuauguuaucgguucauggcucgcaacauagcgguaugauuguaaaugauacaggacacgaaacagacgaaaacagagcaaaaguagaaauaacuccaaauagcccaagagcagaagccacacuagguggauuugguaguuuaggacuagauugugaaccaagaacaggauuagauuuuagugaccuauauuauuuaacaaugaauaauaaacacugguuaguucauaaagaaugguuucacgauauuccauuaccuuggcaugcaggugcggacacaggaacgccacauuggaacaauaaagaagcuuuaguagaauucaaagaugcucaugcaaaaagacaaacaguaguaguacuaggaagucaagaaggagcgguacauacagcacuagcaggugcauuagaagcagaaauggauggagcgaaaggcagacuaucaucuggacaucuaaaauguagauuaaaaauggacaaacuaaggcuaaaaggaguaaguuacucacuauguacagcagcauucacauuuacaaaaauuccagccgaaacguuacacggaacaguaacggucgaagugcaauaugcaggaacugauggacccuguaaaguaccugcucaaauggcaguagauaugcaaacacuuacaccaguaggaagauuaauaacagcuaauccaguaauaacagaaucuacagagaacucaaaaaugaugcucgaauuagacccaccauucggugauaguuauauaguaauaggaguaggagaaaagaaaauaacacaucacuggcacagaucagguucaacaauuggaaaggcauuugaagcuacuguuagaggagcaaaacgaauggcaguauugggugacacggcaugggauuuuggaucaguaggaggagcuuugaauucucuaggcaaaggaauacaccaaauauucggagcagccuucaaaucucuauuuggagguaugagcugguucucacaaauauuaauagguacuuuauuaaugugguuaggauuaaacacuaaaaauggaucaauaucccuaauguguuuagcguuaggagguguauuaauauuccuaaguacagcugucagcgccgauugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9159 - RNA, 2317 nt, Artificial Sequence
  ZIKV prME variant mRNA Design 3 opt
gggagaaagcuuaccauggaaaaaaaaagacgaggggcggauacaucaguaggaauaguugguuuauuauuaacaaccgcaauggcagcagaaguaacuagaagaggaucagcauauuauauguauuuagauagaaaugaugcaggagaggcaauaucauuuccuacaacacuuggaaugaauaaauguuacauacagauuauggauuugggacacaugugugacgcaacaaugaguuacgaaugcccaaugcuagaugaagggguagaaccagacgacguggauuguugguguaacacaaccucaacgugggucguauacggaacaugccaccauaaaaaaggagaagcccgacggagucgaagagcagugacauuaccaagucauucaacgagaaaauuacaaacuagaagccaaacaugguuagaaagccgagaauacacaaaacaucuuauucgaguagaaaauuggauauuuagaaaucccggguuugcacuagcagcagcagcaauagcaugguuacuaggaucaucaacaucccaaaaagugaucuacuuaguaaugauauugcuuauagcgccagcauauaguauaagguguaucggaguaaguaauagagauuucguagaagguaugaguggaggaacauggguugacauaguuuuggagcauggcgggugcguaacaguaauggcacaagacaaacccacgguagacauagaauuagugacuacuacuguaucaaauauggcagaaguuagaagcuacuguuacgaagcaucaauaucugacauggcaagugauaguagauguccaacccaaggagaagcauaucuagauaaacaaucagauacacaauacguauguaaaagaacucuuguagaucgagguuggggaaaugguugcggcuuauuuggaaaaggaaguuuaguaacaugugcaaaauuugcauguucuaaaaaaaugaccgguaaaucgauacagccggaaaaccuagaauaccgaauuauguuaaguguacaugguucgcagcauucaggaaugauagugaacgacacaggucaugaaacagaugaaaaucgugcuaagguagaaauuacaccaaacucgccaagagcagaagcaacacuaggaggauuugguucacugggauuggauugugaaccuagaacaggccuugauuucucagauuuauauuauuuaacaaugaauaauaaacauuggcuuguacauaaagaaugguuucaugauauaccauuaccauggcacgcuggagcagacacggguacaccacauuggaacaacaaagaagcacuaguagaauuuaaggacgcccaugcaaaaagacaaacugugguaguacuagguagucaagaaggagcuguacauacugcucuggcaggggcauuagaagcugaaauggauggugcaaaaggaagauuaucaaguggacacuuaaaaugcagacuaaaaauggacaaauuaagauuaaaaggaguuucauauaguuuauguacagcagcauuuacuuuuacaaaaauuccagcagaaacauuacauggcacaguaacuguagaaguccaauaugcaggaacagacggaccuuguaaaguuccagcacaaauggcaguagacaugcaaacguuaacaccaguuggaagacuuauaacugcaaauccaguaauaacagaaaguacagagaauaguaaaaugaugcuagaauuagauccaccuuucggagauucauauauuguaauagguguaggagaaaaaaaaauaacacaccacuggcaucgaagugguaguacuauaggaaaagcauuugaagcuacagucaggggagcaaagagaauggccguacuaggagauacagcaugggacuucggaagcguuggaggugcccuaaauucauuagggaaagguauacaccaaauauucggcgccgcauuuaaaagccuauuuggaggaaugaguugguuuucacaaauacuaauaggcacauuauuaaugugguuaggcuuaaacacaaaaaauggaucaauaagucuaauguguuuagcauuaggaggaguauuaauuuuucuaucaacagcuguaucugcugacugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9160 - RNA, 2314 nt, Artificial Sequence
  ZIKV prME variant mRNA Design 3 opt
gggagaaagcuuaccaugaaaaaaagaagaggagcagacacaaguguaggaauaguaggacuauuauuaacaacugcaauggcagcagaaguaacaagaagaggaucagcguauuauauguaucucgauagaaaugaugcaggagaggcaauauccuucccaacaacucuuggaaugaacaaaugcuauauacaaauuauggauuuaggacauaugugcgaugcaaccauguccuacgaauguccaauguuagaugaagguguagaaccugaugauguagauuguugguguaauacaacaaguacuugggugguauauggaacaugccaucauaaaaaaggagaggcaagaagaagcaggagagcgguaacacuaccaucccauagcacacgaaaacuacaaacuagaagucaaacauggcuagaaagcagagaauacacuaaacaucuuauaagaguagaaaauuggauauuuagaaacccaggguuugcgcuagcagccgcagccauugcuugguuauuaggcucaucaacaagccaaaaaguaauauaccuaguaaugauacuacuaauagcgccugcauauucaauuagaugcauuggagucuccaauagagauuuuguagaaggaaugaguggagggacaugggucgacauaguacuagaacacggagguuguguuacagugauggcgcaagauaaaccaaccgucgauauagaauuaguaacuacaacaguaucaaauauggcagaaguaagauccuauuguuaugaagcaucgauaagcgauauggccucagauucuagaugucccacacaaggagaagcuuacuuagauaaacaaucugauacacaauaugucuguaaaagaacacucguagauagaggauggggaaauggauguggccuauucggaaaagguaguuuaguaacaugugcaaaauuugcauguagcaaaaaaaugacaggaaaaagcauucaaccagaaaaucuggaauauagaauaauguuaucuguacauggaagucaacauucagggaugauaguuaaugauacaggacacgaaacagaugaaaaucgagcaaaaguugaaauaacaccuaauaguccaagagcagaagcaacauuaggaggauuuggaagucuaggauuagacugugaaccuagaacuggauuggauuuuagugacuuauauuaucuuacuaugaauaauaaacacuggcuuguucauaaagaaugguuccacgauauaccacuaccauggcaugcaggcgcugacacagguacaccccauuggaauaacaaagaagcacuaguagaauucaaagaugcucaugcaaaaagacaaacagucguaguucuaggaagucaagaaggagcaguacacacagcuuuagcuggagcauuagaagcagaaauggauggugcaaaaggacgacuaucaucaggacacuuaaaaugcagacuaaaaauggauaaauuaagacuaaaaggaguaucauauaguuuguguacagccgcauuuaccuuuacaaaaauuccagcugaaacauuacacggaacuguaacaguggaaguacaauaugcagguacagacggaccguguaagguaccagcucagauggcaguagauaugcaaacauuaacgcccguugguagauuaauaacugcaaauccagugauaacagaaucaacagagaauagcaaaaugaugcuagaauuagaucccccauuuggagauagcuauauaguaauuggaguaggagaaaaaaaaauaacacaucauuggcaucgaucaggauccacuauagguaaagcuuuugaagcaacaguaagaggggcuaaaagaauggcgguauuaggagauacagccugggauuuuggaucagucggaggugcauuaaacaguuuagguaaaggaauucaucaaauauuuggagcagcauucaaaagcuuauuuggagguaugucaugguuuucgcaaauacugauuggaacauugcuaauguggcuaggacuaaauacuaaaaauggaaguaucucauuaaugugucuagcacuaggagguguauuaauauuucucagcacagcagucucagcagauugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9161 - RNA, 2311 nt, Artificial Sequence
  ZIKV prME variant mRNA Design 3 opt
gggagaaagcuuaccaugaaaagaagaggugcagauacaucaguaggaauaguuggguuauuacuaacaacagcaauggcagcagaaguaacgagaagggguagugcguacuauauguaccuagaccgaaaugaugcaggugaagcuauaagcuuuccaaccacacuaggcaugaauaaauguuauauacaaauaauggaucuaggacauaugugugaugcuacaaugaguuacgaauguccaaugcuagacgaaggaguagagccagacgauguagacuguugguguaauacgacaucaacauggguaguauaugguacaugucaucacaaaaaaggcgaagcaagacgaucaaggagagccgucacucuaccaagucacagcacaagaaaacuacaaacuagaagucaaacaugguuagaaucaagagaauauacaaaacaucuaauaaggguggaaaacuggauauucagaaauccagguuuugcacuagcagcagcagcgauagcuugguuauuagguaguucuacuucacaaaaaguuauauacuugguaaugauuuuauuaauagcacccgcauacaguauaaggugcauuggaguaaguaauagagauuuuguagagggaaugaguggaggaacauggguagauauaguauuagaacauggaggcuguguaacugugauggcacaagacaaaccuacaguagacauugaauuaguaacgacaacaguuucaaauauggcagaaguaagaucuuauuguuaugaagcaaguauaagcgauauggcaagugacagcagauguccaacacaaggggaagcuuaucuugacaagcaaucagacacgcaauacguuuguaaacggacauuaguagauaggggcugggggaacggauguggauuauuuggaaaaggguccuuaguaacaugcgcaaaauucgccuguaguaaaaaaaugacaggaaaaucuauacaaccagaaaaucucgaauauagaauaauguuaucaguacauggaagucaacauucagggaugauaguaaaugauacuggccaugaaacagacgaaaauagagcaaaaguagaaauaacaccuaauagucccagagcagaagcaacauuaggaggauucggaucauuaggauuagacugugaaccaagaacaggccuagauuucucugacuuauauuaccuaacaaugaauaauaaacacuggcuaguucacaaagagugguuucaugacauaccgcuaccuuggcaugcaggugcagauacaggaacgccacauuggaauaauaaagaagcacuaguagaguuuaaagaugcucaugcaaaaagacaaacgguaguaguauuaggaagccaagaaggagcaguacacacagcucuagcaggagcucuugaagcagaaauggauggugcuaaaggucgauuaucauccggacacuuaaaauguagauuaaaaauggacaaacuaagauuaaaaggaguaagcuacagccuauguacagcagcauuuacauuuacaaaaauaccagcagaaacuuuacauggaacaguaacaguugaaguacaauaugcaggaacagaugggccauguaaaguuccugcgcaaauggcaguagacaugcaaacauuaacaccaguaggaagauugauaacagcaaauccaguaauaacugaaucaacugaaaacucaaaaaugaugcuagaacuagacccaccauucggagauagcuauauaguaauuggaguuggcgaaaaaaaaauaacacaucauuggcacagaaguggaaguacgauuggaaaagcauuugaggcaacaguaagaggugcuaaaagaauggcaguacuuggagacacagcuugggauuuugguagcguaggaggagcauuaaauucacuuggaaaaggaauucaucaaauauucggagcagccuucaaaucacuauuuggaggaaugaguugguuuucacagauauuaauugggacacuucuaauguggcuaggauugaauacaaaaaaugggaguauaucuuuaaugugucuagcauuaggggguguauuaauauucuugucaacagcugugucugccgauugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9162 - RNA, 2308 nt, Artificial Sequence
  ZIKV prME variant mRNA Design 3 opt
gggagaaagcuuaccaugagaagaggcgcagauacaucagucggaauuguuggucuuuuguuaacuacagcaauggcagcagaaguaacaagacguggaagugcguacuacauguaccuagacagaaaugaugcaggagaagcaaucucauuuccuacuacucuggguaugaacaaaugcuauauacaaauaauggaucuaggccauaugugugaugcgacaaugucauaugaguguccaaugcuagacgaagguguugaaccugacgauguagauugcugguguaacacaacaucaacauggguaguauauggaacaugccaccauaagaaaggagaagcuagaagaucaagacgagcaguaacauuacccagucauaguacaagaaaauuacagacaagaagccaaacauggcuagaaucgagagaauauacuaaacaucuaauaagaguagaaaauuggauauuccgaaacccaggauuugccuuggcagcagcugccaucgcauggcuuuuaggaaguucgacaagccaaaaaguaauauaucuaguuaugauacuucucauagcaccagcuuauucaauaagauguaucgguguuaguaacagagauuuuguagaagguauguccggagguacuuggguugauauaguauuagaacaugguggauguguuacuguaauggcacaagauaaaccaacaguagauauagaauuaguaacaacuacaguaagcaacauggcagaaguaagaucuuauuguuaugaagcaucaauaucagauauggcaagugauaguagaugcccaacccaaggagaagcauacuuagauaaacagucagauacacaauauguauguaaacgaacuuuaguugaucgaggguggggaaacggaugugguuuauuuggaaaaggaaguuuaguaacaugugcuaaauuugcaugcucaaagaaaaugacaggaaaaucaauacaaccagaaaauuuagaauauaggauaaugcuuagcguacauggaucacaacauuccggaaugauuguaaaugacacgggacaugaaacugaugaaaacagagcuaaagucgaaauaacaccuaauaguccucgagcagaagcaacauuaggaggauuugguagcuuaggacuugacugugaaccuagaacaggacuagauuuuagugaucuauacuaccuuaccaugaauaauaaacauuggcuaguacacaaagaaugguuucaugacauaccauuaccauggcaugccggagcagacacagguacaccucacuggaauaauaaagaagcccuaguagaauuuaaagaugcacacgcaaaacgacaaacagugguggucuuaggaagccaagaaggagcaguacauacagcauuagccggugcucuagaagcagaaauggauggugcaaaaggaagacuuagcucaggacauuuaaaauguagguuaaaaauggauaaauuaagguuaaaaggaguaucauauagucuaugcacagcagcauuuacuuucacaaaaauacccgccgaaacgcuacacggaacaguaacaguagaaguacaauacgcaggaacugaugguccauguaaaguaccagcucaaauggcaguagacaugcaaacauuaacaccaguagguagguuaauaaccgcgaauccaguaauaacugaaucaacagaaaauagcaaaaugauguuagaacuagacccuccauucggagauagcuauauaguaauagguguaggagagaagaaaaucacacaucauuggcauagaaguggaucaacaauaggaaaagcauuugaagcuacaguaagaggagcaaaacguauggcaguauugggagauacugcaugggauuuuggaaguguagggggagcucuaaauucacuuggcaaaggaauacaucaaauauuuggagcagcauuuaaauccuuauucggaggaaugucuugguuuagccaaauacuaauaggaacuuuauuaauguggcuuggacuaaacacuaaaaauggaucaauuucuuuaaugugucuagcucuaggaggaguacuuaucuuucuaaguacagcagugagugcagacugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9163 - RNA, 2305 nt, Artificial Sequence
  ZIKV prME variant mRNA Design 3 opt
gggagaaagcuuaccaugagaggagcagacacaaguguagguauaguuggauuauuauuaacaacagcaauggcagccgaaguaacaagaagagguucagcuuauuauauguauuuagacagaaaugaugcaggagaagcaauaucauucccaaccacgcuuggaaugaauaaaugcuauauacaaauaauggauuuaggacacaugugugaugcaacaaugucauaugaaugccccauguuagaugaagguguagaaccagaugacguagacuguugguguaauacaacgagcacaugggucguauauggaacuugccaucauaagaaaggagaagcuagacgaagcagacgagcaguaacgcuaccaagucacucaaccagaaaauugcaaacaaggagucaaacauggcuagaaucaagagaauauacuaaacaucuuaucagaguagaaaauuggauuuuucgaaauccaggauuugcacuugcugcagcugcuauagcauggcuauuagguucaagcaccucacaaaaaguaauauaucuaguuaugauacuauuaauugccccugcauacucaauuagauguauaggaguaucaaauagagacuucguagagggaaugucaggaggaacuuggguagauauaguacuagaacaugguggauguguaacaguaauggcacaagauaaaccaacuguugacauagaauuaguaacaacaaccguaaguaauauggcagaaguaagauccuacugcuaugaggcaaguauaagcgauauggcaucagauagucgauguccaacacaaggggaagcauauuuagauaaacaaucagauacgcaauacgucuguaaaagaacauuaguggacagaggaugggguaaugguuguggacuauucggaaaagguagcuuaguuacaugugcaaaauuugcauguaguaagaaaaugacaggaaaaucaauucaacccgaaaacuuagaauauagaauaaugcuaucaguacauggaagucaacauucagguaugauuguaaacgauaccggccaugaaaccgaugaaaauagagcuaaaguagaaauaacgccuaauagcccaagagcggaagcaacacugggaggauuugggagcuuaggauuggauugugaaccaagaacaggacuagauuucucugacuuauauuaccuaaccaugaauaauaaacauugguuaguacauaaagaaugguuucaugauauaccacuaccguggcaugcaggggcagauaccggaaccccacacuggaauaauaaagaagccuuaguagaauuuaaagacgcgcaugcaaaaagacaaacuguaguaguauuaggaucacaagaaggggcaguucacaccgccuuagcaggagcacuagaagcagaaauggauggagcuaaaggucgacuaucaucaggacauuuaaaauguagacuuaaaauggauaaauuaagauuaaaaggaguuaguuacucauuaugcacugcagcauucacuuucaccaaaauaccagcagaaacauuacauggcacuguaacaguagagguacaauaugccggaacagauggacccugcaaaguaccagcgcagauggcugucgauaugcaaacauuaacuccaguuggucgacucauaacugcuaaucccguaauaacagaaucaacagaaaauucaaaaaugaugcuugaauuagauccucccuuuggagauucauauauaguaauaggaguaggggaaaagaaaauaacccaccauuggcauagaaguggaaguacaauugguaaagcauuugaagcaacaguuagaggagcaaaaagaauggcgguauuaggagauacagcgugggacuucggcagcguaggaggcgccuuaaauucuuuaggaaaagggauacaucaaauauuuggagcagcauucaaaucauuauucggaggaaugucaugguuuucacaaaucuuaauaggaacucuauuaaugugguuaggucuaaauacuaaaaacggcucaauaaguuuaauguguuuggcacuaggcggaguacuaauuuuccuaucgacagcaguauccgcagacugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9164 - RNA, 2302 nt, Artificial Sequence
  ZIKV prME variant mRNA Design 3 opt
gggagaaagcuuaccaugggagcggauacaucaguugguauaguaggacuguuauuaacaacagcuauggcugcagaaguaaccagaagaggaucagcauauuauauguauuuagauagaaaugaugcuggagaagcuauaucauuucccaccaccuuaggaaugaauaaauguuacauucaaauaauggauuugggacacaugugcgaugcaacaaugagcuaugagugucccauguuagacgaaggaguugaaccagaugacguagauuguugguguaauacgacaaguacuuggguaguauacggcacaugucaucacaagaaaggagaagcacgccgcucaagacgagcuguaacccuucccagucauaguacaaggaaauugcaaacucguagccaaacaugguuagaauccagagaauauaccaaacaucucauaagaguagaaaacuggauauuuagaaauccaggauucgcauuagcugcagcagcaauagcauggcuccuaggaucaagcacaucccaaaaaguuauauaccuaguuaugauauuauuaauagcuccagcauauucaauuagauguauaggaguuucaaaccgugacuuuguugaaggcaugucaggaggaacauggguagauauaguacuagaacacggaggauguguaacuguaauggcacaagacaaacccacaguugauauagagcuaguuacuacaacaguaaguaauauggcagaaguaagaaguuauugcuacgaagcaucaauaagugauauggcaagugacaguagaugcccaacccaaggagaagcguacuuagacaaacaaagugauacccaauauguuuguaaaagaacacuuguugaucgaggauggggaaauggaugcggacucuuugguaaaggaucauuaguaacaugugcaaaauuugccuguagcaagaaaaugacaggaaaaucaauacaaccagaaaaccuagaauauagaauaauguuaucuguacaugguucacaacauucagguaugauugucaacgacacaggacaugaaacugaugaaaauagagcaaaagucgaaauaacuccaaauucaccacgagcagaagccacuuuaggggguuuuggaagucuaggauuagacugugaaccaaggacaggauuagauuuuucagaucuauauuauuuaacaaugaacaacaaacauuggcuaguacacaaagaaugguuucaugacauaccauuacccuggcacgcaggcgcugacacuggaacuccgcacuggaauaauaaagaagcccuaguugaguucaaagacgcacaugcaaaaagacaaacaguaguuguauuaggaucacaagaaggagcuguacauacagcauuggccggagcauuagaagcugaaauggauggagcaaaagguagacuaagcagcggccaucucaaaugcagauuaaaaauggacaaacuaagacuaaaaggcguuucauacucacuauguacagcagcuuuuacauuuacuaaaauaccugcagaaacauuacaugguacaguaacaguugaaguacaauaugcaggaacagauggaccaugcaaaguaccagcacaaauggcagucgauaugcagacauuaacgccaguaggacgacuaauaacagcaaauccuguaauaacagaaagcacagaaaauucaaaaaugaugcuagaacucgacccucccuucggggauucauauauaguaauaggaguaggcgaaaagaaaauaacacaccauuggcaucguucaggaaguacuauaggaaaagcauucgaagccacaguaagaggugcaaaaaggauggcaguguuaggagauacagcaugggauuuuggaucagucggaggagcacuaaauagcuuaggaaaaggaauacaucagauauuuggagcagcauuuaaaaguuuauucgguggaaugucuugguucucucaaauuuuaauaggaaccuuacuuaugugguuggggcuaaauaccaaaaauggaucaauaucauuaaugugcuuagcucuaggagguguacuaauauuucuaucgacagcaguguccgcagauugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9165 - RNA, 2299 nt, Artificial Sequence
  ZIKV prME variant mRNA Design 3 opt
gggagaaagcuuaccauggcugauacaucaguaggcauaguaggucuacuuuuaacaacagcaauggcagcugaaguaacaaggcgagguagcgcuuauuacauguacuuagauagaaaugaugcaggggaagcuauaucuuuuccgacaacauuaggaaugaauaaaugcuauauucaaauaauggaccugggacauaugugugaugcgacaaugaguuaugaaugcccaauguuagaugaaggaguugaaccggaugacguagacugcugguguaauacaacaaguacaugggucguauaugguacaugucaucauaaaaaaggagaagcaagaagaucaagaagagcaguuacauuaccuucacacucuacaagaaaauugcaaacacgaagccaaacguggcuugaaucaagagaguacacaaaacauuuaauccgaguagaaaauuggauuuucagaaauccaggauucgcacuagccgcagcagcaauagcaugguuacucggaucaaguacaucacaaaaaguaauuuacuuaguaaugauauuacuaauagccccagcauauaguauaagauguauaggaguaaguaauagagauuuuguggaaggaaugaguggagguacguggguagauauuguauuagaacaugguggauguguaacaguaauggcacaggauaaaccaacaguagacauugaauuaguaacaacaaccguaucaaacauggcagaaguaagaucauacuguuaugaagcaaguauaucugauauggcgagcgacucaagauguccuacacaaggugaagcguaucuagauaaacaauccgauacucaauauguauguaaaagaacccuaguagacagaggguggggcaaugguugugguuuauuuggcaaaggaucauugguaacaugugcaaaauucgcaugcucaaaaaaaaugacuggaaaaucaauucagccggaaaaccuagaauauagaauaauguuaucuguucacggaagucaacacucaggaaugauuguaaacgauacuggucacgaaacugaugaaaauagagcuaaaguagaaauaacaccaaauaguccaagagcagaagccacccuugguggauucggaagucuaggauuagauugcgaaccaaggaccggauuagacuucucagauuuauauuaucuaacuaugaauaauaaacauuggcuaguacacaaagaaugguuucacgauauaccuuuaccauggcaugcaggagcagauaccgguacaccacacuggaacaauaaagaagcuuuaguagaauuuaaagaugcucacgcaaaacgacaaacgguuguaguacuaggaucacaagaaggagcaguccacacagcauuagcgggagccuuagaagcagaaauggauggagcaaaaggaagacuuaguucaggacauuuaaaaugccgauuaaaaauggauaagcuuagacuaaaaggaguaaguuacagccugugcacagcugcauuuacauuuacaaaaaucccagcggaaacauuacauggaaccgucacaguagaaguacaauacgccggaacagauggcccaugcaaaguaccagcucaaauggcuguagauaugcaaacacuaacaccaguaggaagacuaauaacagccaacccaguaauaaccgagucuacagaaaacaguaaaaugauguuagaacucgauccuccauuuggagauagcuauauaguaauugguguaggagaaaaaaaaauaacacaucauuggcaucgaucagguucaacaauagguaaagcauuugaagcuacaguacgaggagccaaaagaauggcaguauugggugauacagcaugggauuuuggaucugucggaggagcauuaaacucauuaggaaaagguauacaucaaauauuuggugcugcauucaaaagcuuauuuggaggaaugucaugguuuucccaaauucuaauaggaacauuauuaaugugguuaggauuaaacacgaaaaaugggucaauaagucuaaugugccuugcauuagguggaguacuaauauuucuaagcacugcaguaucagcugauugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9166 - RNA, 2296 nt, Artificial Sequence
  ZIKV prME variant mRNA Design 3 opt
gggagaaagcuuaccauggacacaaguguaggaauaguaggauuguuauuaacaacugcaauggcagcagaagucacucgucgugguagcgcauacuauauguauuuagauagaaaugaugcaggagaagcaauaucuuuuccgacaacauuaggaaugaacaaauguuauauacaaauaauggauuuaggucauaugugugacgcuacgaugucauaugaauguccaauguuggaugaaggaguagaaccagaugacgucgauuguuggugcaauacgacauccacauggguaguuuaugggacaugucaucauaagaaaggagaagcgaggagaagcaggagagcaguaaccuuaccaagucacagcacaagaaaacuacaaacaagaagucaaacaugguuagaaucaagagaauauaccaaacacuuaauaaggguggaaaauuggauauuucgaaauccaggauuugcauuagcagcagcugcaaucgcgugguuauuaggaucaucaacaucacagaaaguaauauaccuaguuaugauauuauuaauagcaccagcauauagcauaagaugcauaggagugaguaauagagauuuuguagaaggaaugaguggaggcaccuggguagauauaguacuagaacauggcggaugugucaccguuauggcucaagauaaaccaacaguagauauagaauuaguaacuacaacaguaucaaauauggcagaaguaagaaguuacugcuaugaggcuucaauaagugacauggcuucagauucaagauguccgacacaaggagaagcauauuuagauaaacagucugauacucaauauguaugcaaaagaacccuaguagacagaggauggggaaaugguugugguuuauucggaaaaggaagucugguuacaugugcaaaauucgcaugcucuaagaaaaugacaggaaaaucaauccaaccagaaaaccuagaauacagaauaauguuaucaguacacggcucacaacauaguggaaugauagugaaugauacuggacacgaaacugaugaaaaucgagcaaaaguagaaauaacacccaacaguccgagagcagaagcuacauuaggaggauuugguucauuaggauuggauugcgaaccaagaacagguuuagacuuuagugauuuauauuaucuuaccaugaauaacaaacauuggcuuguacauaaagaaugguuucaugacauuccucuaccauggcaugccggagcagauacggguacuccacacuggaauaauaaagaagcauugguagaauuuaaagaugcacaugcaaaaagacaaacuguaguaguauuaggaagucaagaaggagcaguucauacugcguuagcuggagcauuagaagccgaaauggauggagcaaagggaagauuaucaaguggacaccuuaaaugccgacugaaaauggauaaacuaagacuuaaagguguuucuuauucuuuauguacugcggcuuucacauuuacgaaaauacccgcugaaacacuucaugguacuguaacaguagaaguacaauaugcaggaacagacggaccauguaaaguaccagcacaaauggcagucgauaugcaaacacuuacaccaguagguagacuuaucacagcgaauccaguuauaacugaaaguacagaaaauaguaaaaugaugcuggaauuagauccuccuuucggagacaguuacauaguuauugguguaggggaaaagaaaauaacacaucacuggcauagaaguggaucaacuauaggaaaagcauuugaagcaacaguccguggagcaaaacgaauggcaguacuaggcgauacugcaugggauuuugguagcguugguggagcacuaaauucacuuggaaaaggaauacaccaaauauuuggagcagcauuuaaaucacuuuuugguggcaugucaugguuuucacaaauuuuaauuggaacauuauuaauguggcuaggauuaaauacuaaaaacgguaguauaucguuaaugugucuagcacuagguggagucuuaauauuucuuaguacagcaguuagugcagauugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9167 - RNA, 2293 nt, Artificial Sequence
  ZIKV prME variant mRNA Design 3 opt
gggagaaagcuuaccaugacaagugucggaauaguaggauuauuguuaacaacggcaauggccgcagaagugacgagaagggggucugcuuauuauauguaucuugauagaaaugaugcaggagaagcuauaaguuuuccaacaacucuaggaaugaauaaauguuacauucagauaauggacuuagggcauaugugcgaugcaacaaugucauacgagugcccaaugcuagaugaaggaguagaaccagaugacguugacugcugguguaauacaacuucaacauggguagucuacgguacaugucaucacaaaaaaggagaagcaagaagaucuagaagggcagugacauuaccuagucauagcacgaggaaacuccaaacccgaucacaaacauggcuagaaagcagagaauauacaaagcaccuaauaagaguagaaaauuggauuuuuagaaauccaggauucgcauuagcagccgcugcgauugcaugguuacuuggaucaaguacgucgcaaaaaguuauauacuuaguaaugauauugcuaaucgcaccagcauauucgaucagaugcauaggaguaucaaacagagacuucguagaaggaaugaguggaggaacauggguagauauaguacuagaacauggagguugugugacaguaauggcacaagauaaaccaacuguggacauagaacuagugacaacaacaguaucaaacauggcagaaguacgaucuuacuguuaugaagcgucaauaagcgauauggcaagcgauaguagaugcccaacacaaggagaagcauacuuagauaaacaaucagauacucaauauguauguaaacgaacacuaguagauagaggauggggaaauggauguggauuauuuggcaaaggaagucugguaacuugugcaaaauuugcuugcaguaaaaaaaugacaggaaaaaguauacaaccagaaaaccuugaauauaggauuauguuaaguguucacgggagucaacauagugggaugauugucaaugauacaggacaugaaacagacgaaaauagagcaaaagucgaaauaacgccaaacaguccaagagcugaagcgacauuaggaggauuuggaucauuaggacuagauugugaaccaagaacugggcuagacuuuucagacuuauacuaucuaacaaugaauaauaagcacugguuaguucauaaagaaugguuucaugacauaccacuaccuuggcaugcaggagcagauacuggaacuccgcauuggaauaauaaagaagcauuaguagaauucaaagaugcacaugcaaaacgacagacaguagucguacuuggaagucaagaaggagcggugcauacagccuuagcaggagcauuagaagcagagauggacggcgcuaaagguagacuuagcagcggacaucuaaaauguagacuaaaaauggauaaacuaagacuaaaaggaguaucauauucauuauguaccgcagcguucacauuuacaaaaauaccagcggaaacauuacauggaacuguaacaguagaaguacaauaugcaggaacugauggaccauguaaaguaccagcacaaauggcaguagauaugcaaacauuaacacccguaggaagacuaauaacagcaaauccaguaauaacagaaaguacagaaaauucuaaaaugauguuggaauuagacccaccuuuuggagacaguuacauaguaauaggaguaggagaaaaaaaaauaacacaccauuggcauaggaguggaagcaccauaggaaaagcauuugaagcuacuguaagaggagcgaaacgaauggcuguucuaggagauacggcuugggacuuuggaaguguaggaggagcguuaaauagucucggcaaaggaauucaucaaauauucggagcagcauuuaaaucacuauuugguggaaugucaugguuuagucaaauauugauaggaacacuauuaaugugguuaggauuaaauacuaaaaacggcaguauaucacuaaugugcuuagcauuagguggaguuuuaauauuccuaaguacagcaguaagugcagauugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9168 - RNA, 2293 nt, Artificial Sequence
  ZIKV prME variant mRNA Design 3 opt
gggagaaagcuuaccaugacaucaguaggaauuguugguuuacuauuaacaacagcaauggcagccgcaguaacacgccgaggcucggcuuacuauauguauuuagauagaaacgaugcaggagaagcaauaucauuuccaaccacacuggguaugaauaaaugcuauauccaaauaauggaucuaggacauaugugcgacgcaacaaugucauaugaauguccaaugcuagaugaaggagucgaaccagaugauguagauugcugguguaauaccacaaguaccuggguaguauauggcacaugucaucauaagaaaggcgaagcaagaagaaguagacgagcaguaacauuaccaucacauucaacaagaaaacuucaaacaagaagccaaacuuggcuagaaagcagagaauauacaaaacauuuaauaagaguggaaaauuggauauucagaaauccuggcuuugcauuagcugcagcggcuauagcuugguuacuuggaucuaguacuucacagaaaguaauauaucuaguaaugauacuauuaauagcaccagcuuacaguauccgaugcauaggaguaucgaacagagauuuuguagaagggaugucagguggaacauggguagauauaguauuagaacacggcggaugcguaacaguaauggcacaagacaaaccaacaguagacauagaacuuguaacaacaacaguaucaaauauggcagaaguuagaucauacugcuaugaagcaucaauaucagacauggcuucagauaguagauguccaacacaaggagaagccuacuuagauaaacaguccgauacucaauauguauguaaaagaacccuaguagaccgcgguuggggaaaugguugcggacuauucggaaaaggaagucuaguaaccugugcaaaauuugcauguaguaagaaaaugaccggaaaaaguauucaaccagaaaauuuagaauauagaauaauguuaaguguacauggcucucaacauucaggaaugauagucaaugauacaggucaugaaacagaugaaaauagagcuaaagucgaaauaacaccaaauucaccacgugcugaagcaacacuaggaggauuuggaucacucggauuagauugugaaccaaggacaggcuuggauuucucagauuuauauuaucuaacuaugaacaacaaacauugguuaguccauaaagaaugguuucacgauauaccucuaccauggcaugcuggugcagauacaggaacaccccauuggaauaauaaagaagcucuagucgaauuuaaagaugcacacgcaaaacgccagacaguaguuguacuaggaagccaagaaggagcaguacacacagcucuagcaggagcuuuagaagcagaaauggauggugcaaaaggaagacuaagcucaggacaucugaaaugcaggcuaaaaauggauaaauuaagauuaaaaggaguaagcuauucauuauguacagcagcauuuacauucacaaagauaccagcggaaacauuacacgggaccguaaccguagaaguacaauaugcagguacagacggaccauguaaaguaccagcacaaauggcaguagacaugcaaaccuuaacaccaguaggucgauuaauaacagccaauccaguaauaacagaaucaaccgaaaauuccaaaaugaugcuagaauuagauccaccuuucggagauaguuauauaguaauaggaguaggagaaaagaaaaucacacaucacuggcauagaucuggcuccacuauaggaaaagcauuugaagcuaccguuagaggagcaaaaagaauggcugucuuaggagauacugcaugggacuuuggaaguguuggaggugcacuuaacagccuaggaaaaggaauacaucaaauauucggugcagcuuuuaaaagucucuucgguggaauguccugguucucucaaauuuuaauagguacacuacuuauguggcuuggucuaaacaccaaaaauggaucaauaucauuaaugugccuggcacuaggaggaguacuaauauucuuaucaacagcuguaagcgcagauugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9169 - RNA, 2305 nt, Artificial Sequence
  ZIKV prME variant mRNA Design 3 opt
gggagaaagcuuaccaugagaggagcagauacaaguguugguauaguaggcuuacuauuaacaacagcaauggccgcugcuguaacacgaagaggaagugcauauuacauguacuuagaccgaaacgaugcaggagaagccauaucauuuccaacaacguuaggaaugaacaaaugcuacauacagauaauggaucuaggacauaugugugacgcaacgaugucauacgaauguccaauguuagaugaaggcguagaaccagaugauguagauuguuggugcaacacaacaaguacauggguaguauauggcacaugucaccauaaaaaaggggaagccagaagaagcagaagagcgguaacacuaccuucacauaguacuagaaaacuucaaacgcgcucucaaacauggcuugagaguagagaguauacaaaacauuuaauuagaguagaaaauuggauauuucgaaaucccgguuuugcauuagcagcagcagcaauagcauggcugcucggaucaucaacuucacaaaaaguuauauauuuaguaaugauauuacuaauagcaccagcauacagcauacgaugcauaggaguuucaaacagagauuuuguagaaggaaugucuggaggaaccuggguagacauugugcuugagcauggaggaugcguaacuguuauggcacaggacaaaccaacgguugauaucgaauuaguuacaacuacaguaucaaauauggcggagguuagauccuauuguuaugaggcaucuauaucagauauggcaucagauucgagauguccuacucaaggugaagcuuaucuagacaaacaaagugacacgcaauauguuuguaaaagaacuuuaguugacagaggauggggaaauggcugugguuuauuuggaaaagggaguuuaguaacaugugcaaaauuugccuguucuaaaaaaaugacaggcaaaucaauacaaccagaaaauuuagaauauagaauaauguuaucaguacauggaagucaacauagcggaaugauaguuaaugauacaggacacgaaaccgaugaaaaccgugcuaaaguugaaauaacaccaaauucaccaagagcagaagcaacauuaggaggauucggauccuuaggacuugacugugaaccaagaacaggacuagacuuuagugacuuauauuauuugacaaugaauaauaaacauugguuaguacauaaagaaugguuucacgauauaccauuaccuuggcacgcaggagcagauacaggcacaccacauuggaauaacaaagaagcuuuaguagaauucaaagacgcacacgcaaaacgacaaacuguugucguacuaggaucacaagagggugcaguacacacagcgcuagcuggagcauuagaagcagaaauggacggagcuaaaggacgcuuaucaucagggcaccuaaaaugucgacuaaaaauggauaaacuaagguuaaaaggaguauccuauucccuauguacagcagcauucacauucacaaaaauaccagcagaaacauuacacggaacaguuacuguggaaguacaauaugcaggaacagauggaccauguaaaguuccagcucaaauggccguagacaugcaaacguuaacaccaguaggaagacuuauuacagcgaacccaguuauaacagaaaguacugaaaauaguaaaaugauguuggaauuagauccuccauuuggagauucuuauauaguaaucggcguaggggaaaaaaagauaacacaucauuggcacagaagcggaucuacaaucggaaaagcauuugaagcaacaguaagaggcgcaaaaagaauggcaguacuaggagauaccgcaugggauuuugguaguguaggaggagcacuaaauagccuaggaaaaggaauacaccaaauauucggggcagcauucaaaagcuuauuugguggaaugucaugguucagccaaauacuaauaggaacauuauuaauguggcuuggacucaacaccaaaaauggaucuauuagccuaaugugcuuagcguuaggaggaguacuaauauucuuaucaacagcaguaagugcagauugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9170 - RNA, 2329 nt, Artificial Sequence
  ZIKV prME variant mRNA Design 3 opt
gggagaaagcuuaccaugcgaggauuaucaucaaggaaacgaagaagccaugacgucuuaacuguacaauucuuaauacuaggaaugcuauuaaugacaggcgguguaacaagaagaggaagugcauacuacauguaucuugacagaaacgaugcgggugaagccauaagcuuuccaacaaccuuaggaaugaauaaauguuacauacaaauuauggacuuagggcauaugugcgaugcaacaaugaguuaugaauguccuaugcuagaugagggaguagaaccugacgauguagacuguuggugcaacacaacaucaacuugggucguuuaugggacuugucaccauaaaaaaggugaggcaagaagaaguagaagagcaguaacauuaccuucacauuccacaagaaaauugcaaacacgaucacaaacaugguuagaaaguagagaauacacaaaacaccuuauaagagucgaaaauuggauauuucgaaauccaggcuuugccuuggcugcugcagcaauugccuggcuauuagguaguucuacuagucaaaaagugauauauuuagugaugauuuuauugauagcaccggcauauagcauaagauguauuggcguaaguaauagagauuuuguugaagguaugaguggugguaccuggguagauauaguccuagaacauggaggauguguaacaguaauggcacaagauaaaccaacaguagauaucgaacuaguaacuacaacugucucaaacauggcagagguuagaaguuauuguuacgaagcaaguauaagugauauggcaagcgauucucgauguccaacacaaggugaagcuuacuuagauaaacaaucagauacacaauauguauguaaaagaacacuaguugacagaggaugggguaauggauguggacuauuuggaaaaggauccuuagucacuugcgcuaaauuugccuguagcaaaaaaaugacggguaaaucaauacaacccgaaaauuuagaauaccgaauuauguugaguguucauggaucucaacauucagguaugauuguaaaugauacaggacaugaaacagaugaaaaccgagcaaaaguagaaaucacuccaaacagcccuagagcagaggcaacccuuggaggauucggaaguuuaggccuagauugugaaccaagaacaggauuagauuuuagugacuuauacuaccuaacaaugaauaauaaacauugguuaguacauaaagaaugguuucaugauauacccuuaccuuggcaugcuggagcagacacaggaacgccacauuggaauaacaaagaagcacuaguugaauuuaaagaugcacaugcaaaaagacaaacaguaguaguauuaggaagucaagagggagcagugcacacagcuuuagcaggcgcacuagaagcugaaauggacggugcaaaagguagacuaucaaguggacacuuaaaauguagacuaaaaauggacaaauuaagauuaaaaggggugucauauucuuuauguacagcugcauuuacauucacuaaaauuccagcagaaacacuacauggaacaguaacaguggaaguacaauaugcaggaacagauggaccaugcaaagugccugcacaaauggcaguagauaugcaaaccuuaaccccaguaggaagauuaauaacggcaaacccgguaauaaccgaaucaacugaaaacaguaaaaugauguuggaacuagauccaccauuuggagauucauauauaguuauaggagugggagaaaaaaaaauaacccaucauuggcauagaaguggaagcacaauaggaaaggcauucgaagcuacagucagaggagcaaaaagaauggcuguucuuggagauacagcaugggauuuugguaguguugguggagcuuuaaauagccuuggaaaaggaauucaucaaauauuuggagcagcauucaaaagcuuauuuggaggaaugucuugguuuucacaaauauugauaggaacacuuuuaaugugguuaggauugaacacaaagaacggaaguauaucuuuaauguguuuagcauuaggugguguucuaauuuuucuaucaaccgcaguaagugcagauugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9171 - RNA, 2329 nt, Artificial Sequence
  ZIKV prME variant mRNA Design 3 opt
gggagaaagcuuaccaugagaggauugaguaguagaaaacgacgaagucacgauguucuaacaguacaauuucuaauuuuagguaugcuauugaugacaggagcaguaacaagacgaggaucagcauauuauauguauuuagauagaaaugaugcaggagaagcaauaaguuuuccaacuacuuuaggaaugaacaaauguuauauucaaauaauggauuuaggccauaugugugaugcuacaaugaguuaugaaugcccaauguuagacgaaggaguagaaccagacgacguagauuguugguguaauacaacaucaacauggguaguguauggcacaugucaucacaagaaaggagaagcgagaagaaguagacgagcaguuacacuaccaagucauagcacgagaaaauuacaaacaagaucacagaccugguuagaaucaagagaauacacuaaacaccugauaagaguagaaaauuggauuuuuagaaaucccggauuugcacuagcagcugcagcuauagcuuggcuauuagguaguuccacuagccaaaaaguaauuuaccuaguaaugauauuacuaauagcaccagcauauaguauaagaugcauaggagugucaaauagagauuuuguagaaggaaugagcggugguacauggguggauauagucuuagaacauggaggauguguaaccguaauggcacaagacaaaccaacaguugauaucgaacuuguaacaacaacgguaucaaauauggcugaaguaagaucauacuguuaugaagcaaguauaucagauauggcaagugacucaagaugcccaacacaaggagaagcauaucuagauaaacaaucagacacacaauaugugugcaaaagaacauuaguagacagaggauggggaaauggauguggacuauucggaaaagggagcuuaguaacaugcgcuaaauucgcgugcaguaagaaaaugacaggaaaaaguauacaaccagaaaauuuagaauauagaauaaugcuaucaguacacggaucgcaacauucagguaugauaguaaacgauacaggacaugaaacagaugaaaaccgagcuaaaguggaaauaacgccaaauucacccagagccgaagcaacauuaggggguuucggaaguuugggauuggauugcgaaccuagaacgggguuagauuuuucagauuuauauuaccuaacaaugaauaauaaacauuggcucguacacaaagaaugguuucaugauauaccuuuaccauggcaugcaggagccgauacugguacuccacauuggaauaauaaagaagcccuaguagaauuuaaggaugcucacgcaaaaagacaaacaguugugguucuaggaagucaagaaggagcgguacauacagcauuagcaggcgcauuagaagcugaaauggauggagcgaaaggucgacugaguucaggacaucuaaaauguagauuaaagauggauaaacuaagacuaaaaggaguaucauauucauuauguacugcagcuuuuacguuuaccaagauuccagcagaaacacuacauggaacuguuacaguagaaguucaauaugcuggaacagacggaccaugcaaaguacccgcacagauggcuguagacaugcagacauuaaccccaguaggacgacuaauaacggcuaacccagucaucacugaaucaacugaaaauucgaaaaugaugcuagaacuagacccaccuuuuggagacaguuauauaguuauuggaguuggagaaaagaaaauaacacaucacuggcauagaagcggaaguacaauagguaaagcauuugaagcaacaguacgcggugcaaaaagaauggcaguuuuaggagauacugcaugggauuucggaucuguagguggagcacuaaacucucuuggaaaagguauucaucaaauauuuggagccgcuuuuaaaaguuuguuuggaggaaugagcugguuuucacagauauuaaucggaaccuuacuaauguggcuaggucuaaauaccaaaaauggaucaauaaguuuaauguguuuagcacuuggaggaguauuaauauuccugagcacagcaguaagugcggacugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9172 - RNA, 2335 nt, Artificial Sequence
  ZIKV prME variant mRNA Design 3 opt
gggagaaagcuuaccaugcgaauaauaaacgccagaaaagaaaaaaagagaagaggggcagauacaucuguggguaucguaggauuauuacuuacaaccgcuauggcggcggaaguaacaagaagaggaucagccuacuauauguaccuagacagaaaugaugcuggugaagcaauaucuuucccuacaacuuuaggaaugaauaaauguuacauccaaauaauggacuuaggacauaugugcgaugcaacuaugucguaugaauguccuauguuagaugaaggaguagaaccggaugacguugauugcugguguaacacaacaagcaccuggguaguauacgggacaugccaucauaaaaaaggggaagcaagacgaagccgaagagcuguuacuuuaccaagucauucaacgagaaaacuucaaacgagaucucaaacauggcuugaauccagagaauauacaaaacauuuaaucaggguagaaaacuggauuuuuagaaauccaggauucgcauuagcagccgcggcgauagcauggcugcuagggucaagcacaucucaaaaaguaauauaucuaguaaugauacuauuaauagccccagcauauucaauaagauguauaggaguaaguaacagagauuuuguagaaggaaugucugguggaaccuggguagauauaguauuagaacauggaggauguguaacugucauggcacaagauaaacccaccguagacauagaacugguaacaacaacaguaucaaauauggcugaaguacguaguuauugcuaugaagcaucaauaucagauauggccucagauucacgauguccuacccaaggagaagccuacuuagauaaacaauccgacacacaauacguguguaaaagaacauuagucgauagaggcuggggaaauggcuguggauuauuuggaaaaggaucacuaguaacaugugcaaaauucgcgugcucaaaaaaaaugacaggaaaauccauucaaccugaaaacuuagaauauagaauuauguuaaguguacacgggucacaacauagcggaaugauaguaaacgacacaggacaugaaacagacgagaacagagccaaaguagaaauaacaccaaauagcccaagagcugaagcaacacuagguggauucggaaguuuaggauuagacugugagccacgaacugguuuagacuucagcgaucuguacuauuuaacaaugaacaauaaacacuggcuaguacauaaagaaugguuccaugauauaccauugccauggcaugcaggagcagauacaggaacaccacauuggaauaauaaagaagcauuaguagaauuuaaagaugcacacgcaaaaagacagacgguaguaguuuuaggaucacaagaaggagcuguccauacagcucucgcgggcgcacuugaagcugaaauggacggagcgaaaggcagacuaucauccggucacuuaaaauguagacuaaaaauggauaaacuaagacuuaaaggaguaucauauucauuauguacugcugcauuuacauuuacuaaaauaccagcagaaacacuucauggaacgguaacuguagaaguacaauaugcugggacagauggaccaugcaaaguaccagcacaaauggcaguugacaugcaaacauugacaccaguuggaagauuaauuacagcaaauccuguaauaacagaaagcacagagaauucaaaaaugauguuagaauuagauccaccguucggagauagcuauauaguaauuggaguaggagaaaaaaaaauaacacaucauuggcacagaucaggaucaacuauaggcaaagcuuuugaagcaacaguuaggggcgcaaaaaggauggcaguauuaggagauacagcaugggacuuuggaagcguaggaggugccuuaaauagucuuggaaaaggaauacaucaaauuuuuggagcagcauuuaaaagucuauuugguggaaugaguugguuuagucaaauucuaauaggaacucuauuaauguggcuaggacuaaauacaaaaaacgggucaauaucauugaugugucuugcauuaggaggagugcuaauauucuuaaguacagccguaagcgcuugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9173 - RNA, 2329 nt, Artificial Sequence
  ZIKV prME variant mRNA Design 3 opt
gggagaaagcuuaccaugauaaacgcaagaaaggaaaaaaaaagaagaggugccgauacaucaguaggaauuguugguuuguuguuaacaacagcaauggcagcagaaguuacgagaagaggaucagcauacuacauguaucuugaccgaaacgaugcaggcgaagcaauaagcuuucccacaacauuaggaaugaauaaauguuauauucagauaauggauuuaggacauaugugcgaugcuacgaugaguuaugaaugucccaugcuagaugaaggaguugaaccagaugauguggauuguugguguaauacaacaucuacguggguaguauacggaacaugccaucauaaaaaaggcgaagcaagaagaucaagacgagcgguaacauuaccuucacauucaacuagaaaacuccaaacgagaagccagacauggcuggaaucaagagaauauacaaaacaucuuauuagaguagaaaacuggauauuucgaaauccagguuucgcuuuagcagcagcagcaauagcauggcuacuaggaucuucuacaucacaaaaaguaauauauuuaguaaugauuuuguuaauagcaccagcauacaguauaagguguauagguguaaguaauagagacuuuguagaaggaaugagcggaggaacguggguagacauaguauuagaacauggaggauguguuacaguaauggcacaggauaaaccuaccguagacauagaauuggucacaacuacagucagcaacauggcugaaguacgaaguuauugcuaugaagcuucaauuagugauauggcaucagauagcagguguccaacacaaggugaagcauauuuagauaaacaaagcgauacacaauauguauguaaaagaacauuaguagacagaggaugggggaaugguuguggacuauuugguaaaggaagcuuaguaacaugcgcuaaauuugcaugcucaaaaaaaaugacuggcaaaagcauacaaccagaaaauuuagaguaucgaauaauguuaucagugcacggaagucaacacucaggaaugaucgugaaugacacaggccaugaaacggaugaaaacagagcaaaaguagaaauaacuccaaacucaccaagagcagaagcaacacuaggaggauuuggaucauuaggacuagacugcgaaccuagaacaggacuagauuucucagauuuauacuaucuuacaaugaauaacaaacauugguuaguccauaaagaaugguuucaugauauuccauuaccauggcaugcaggagcugauacaggaacgccccauuggaauaauaaggaagcuuuaguagaauuuaaagaugcacacgcaaaaagacaaacaguaguuguauuagggagucaagagggugcaguacacacagcauuagcuggugcgcuagaagcagaaauggacggggcaaaaggaagacuuaguucuggacauuuaaaaugcagacuaaaaauggauaaauuaagauuaaaaggcguaaguuauaguuuaugcacugcugcauucacauuuacaaaaauaccagcagaaacauuacauggaacgguaacaguagaaguacaauaugcaggaacugauggaccaugcaaagugcccgcacaaauggcaguggauaugcaaacgcucacaccaguaggaagauuaauaacagcuaauccagucauaacagaaucaacugaaaauucaaagaugauguuagaauuagacccaccuuuuggagauucauacauuguaauaggaguaggagaaaaaaaaauaacacaucauuggcauagaaguggaucaacaauaggaaaagcauuugaagcaacaguacgaggggccaaaagaauggcaguacuaggagauacagcaugggacuuuggaucgguagggggagcucuaaauuccuuaggaaaaggcauacaucaaauauuuggagcggcguucaaaucuuuauuuggcgguaugucuugguucucucaaauuuuaauaggaacccuucuaaugugguuagguuuaaauacuaaaaauggaucuaucagcuuaaugugcuuagcccuaggagguguauuaauuuuuuuaucaacagcaguuucagcuugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9174 - RNA, 2332 nt, Artificial Sequence
  ZIKV prME variant mRNA Design 3 opt
gggagaaagcuuaccaugauaauaaaugcuaggaaagaaaaaaaaagacggggagcagauacaaguguaggaauaguaggauuacuacuaacaaccgccauggcagcagaagucacaagaagagguucagcauacuauauguacuuagacaggaacgaugcaggagaagccauuaguuuuccgacaacacuagguaugaacaaauguuauauacaaauaauggauuuaggacauaugugcgaugcaacaaugucauaugaaugcccaauguuagacgaaggaguagaaccagaugaugucgauuguuggugcaauacaacaucaacauggguaguauacgguacgugucaucacaaaaaaggcgaagcacguagaagucgaagagcaguaacucuaccaagccauaguacaagaaaacuacaaacucgaucacaaacgugguuagaaagcagggaauauacuaaacacuuaauaagaguagaaaacuggauauuucgaaauccagguuuugcuuuagcugcagcagcaauagcauggcuauuagggucauccacgucacaaaaaguaauauauuuaguaaugauauuacuaauagcaccagcguacuccauaagauguauaggaguuagcaauagagacuucguugaaggaaugucugguggaacauggguugauauaguccuugaacacggaggauguguaacggucauggcacaagauaaaccaacuguugauauagaacuaguaaccacaacaguaagcaauauggcagaagucagaucauauuguuacgaagccaguauaagcgauauggcaucagauucaagauguccaacucagggugaagcauauuuggauaaacaaucagauacacaauaugucugcaaacgcaccuuaguagauagagggugggguaaugguuguggacuauuuggaaaaggaucacuaguaacaugcgcaaaauucgcauguucaaaaaaaaugacagggaaauccauacaaccagaaaauuuagaauacagaauaaugcuaucaguccauggaucacaacauagugguaugauuguuaaugauacaggucacgaaacagaugaaaauagagcaaaaguagaaauaacaccaaauaguccaagagcagaagcaacauugggaggauuuggaucucuaggucuagauugugaaccuagaacaggacuggacuuuagugaccuuuauuacuuaacaaugaacaauaaacauuggcuaguacauaaagagugguuccaugauauaccacuaccauggcaugccggagcagauacaggaacuccccacuggaauaauaaagaagcucuaguagaauuuaaagacgcacaugccaaaagacaaacaguagucguauuaggaucccaagaaggagccguacauacagcacuagccggagcauuagaagcagaaauggauggagcaaaaggacgacugagcucaggucaucuaaaauguagauuaaaaauggacaaauuaagauuaaaaggggugucauacagucuauguacagccgcauuuacuuucacaaaaauaccagcugaaacauuacacggcacagugaccguugaaguacaauaugcaggaacagaugguccaugcaaaguacccgcacaaauggcagucgauaugcaaacauuaacaccaguaggaagauuaaucacagcaaauccaguaauaacagaaaguaccgaaaauucaaaaaugauguuggaauuagauccaccauuuggagauaguuauauaguaauaggaguuggagaaaaaaaaaucacccaccacuggcacagaaguggcaguacaauagguaaagcguucgaagcaacugucagaggagcaaaaagaauggccguacuuggagacacagcaugggauuuuggaucaguuggcggcgcucugaacucccuaggaaaaggaauccaucaaauauuuggagcagcauuuaaaaguuuauuuggagguaugaguugguucucacaaauacuaauuggaacacuucuaauguggcuaggacuaaauacaaagaacggcaguauaucauugauguguuuagcgcuaggaggcguacuaaucuuucuaagcacagcgguuucagcuugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9175 - RNA, 2326 nt, Artificial Sequence
  ZIKV prME variant mRNA Design 3 opt
gggagaaagcuuaccaugaaugcaagaaaagaaaagaaaagaagaggugccgauacauccguagguauaguuggcuuauuauuaacaacagccauggcagcugaagugacuagaagagguucagcauauuacauguaucuagauagaaaugacgcaggagaagcaauaaguuuucccacuacauuaggaaugaauaaauguuauauacaaauaauggaucuuggacacaugugcgaugcuacaaugaguuaugaauguccaauguuagaugaaggaguggaaccagaugauguagauuguugguguaacacgacaucaacuuggguaguuuauggaacaugucaucauaagaaaggagaagcaagacgaucaagacgagcaguaacacucccaagccacucuacaagaaaauuacagacaagaucacaaacaugguuagaaucccgagaauacacaaaacaccuaauuagaguagagaacuggauuuuuaggaauccaggauuugcauuagcggccgcugcaauagcauggcuacuaggaucaaguacaagucaaaaagucaucuauuuaguaaugauauuauuaauagccccugcauacucaauaagauguauuggcguaaguaauagagacuuuguagaagggaugaguggaggaacuuggguagauauaguauuagagcauggaggauguguaacaguaauggcacaagacaaaccaacuguagauauugaguuaguaacaacaacugugaguaacauggcagaaguaagauccuauugcuacgaagcauccauuucagauauggcuucagauaguagauguccaacucaaggagaagccuaucuagacaaacaaagugacacacaauauguuuguaaaagaacauuaguagauagaggaugggguaauggauguggcuuauucggaaaagguucauuaguuacaugcgcaaaauuugcuuguucaaagaaaaugaccggcaaaucaauucaacccgaaaauuuagaauauagaauaaugcucaguguacacggaagccaacauucagguaugauaguaaacgauacugggcaugaaacagacgaaaauagagcuaaaguagaaauuacaccaaauuccccaagagcagaagcuacauugggaggauuugggagucuaggacuugauugugaaccaagaacaggucuagacuucagugaucuguacuaucuuacaaugaauaacaaacauuggcuuguccauaaagaaugguuucacgacauaccacuaccauggcaugcaggagcagauacuggaacgccacacuggaauaacaaagaagcauuaguugaauuuaaagaugcacaugcgaaaagacaaacaguaguaguuuuagguagccaagaaggagcuguacauacagcauuagcaggagcauuagaagcagaaauggauggagcgaaagguagauuaucaucaggacaucuaaaaugucgacuaaaaauggauaaauuaagacucaaaggaguuucauacucauuauguacagcagccuuuacuuucaccaaaauaccagcagaaacacugcauggaacuguaacaguugaaguacaauacgcaggaacagauggaccauguaaaguaccagcgcagauggcaguagauaugcaaacacucacaccuguagguagacuaaucacagcaaauccgguaauaacagaaaguacagaaaauucuaaaaugaugcuagaacuagauccgccauucggagacagcuacauaguaauaggaguuggugagaagaaaauaacacaccauuggcacagaucaggaaguacaauaggaaaagcauuugaagcaaccguaagaggagccaaaaggauggcagucuuaggagauacagcaugggauuuuggaaguguagggggugccuuaaauuccuuggguaaagguauacaucaaauuuuuggagcagcauuuaaaucauuauuuggcggcauguccugguucucacaaauacugauaggaacucuauuaauguggcuuggcuuaaauacgaaaaauggaaguauaucauugaugugccuagcauuaggcggaguucuaauauuuuuaaguacagcaguaucagcaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9176 - RNA, 2323 nt, Artificial Sequence
  ZIKV prME variant mRNA Design 3 opt
gggagaaagcuuaccauggcaagaaaagaaaagaaaagaagaggagcggacacaagugugggaauaguaggacuauuauuaacaacagcuauggcagcagagguaacgaggagaggaucagcauauuauauguaucuagaccgaaaugaugcaggagaagcuauuucauucccaacgacucuaggaaugaacaaaugcuacauacaaauaauggacuuaggacauaugugugacgccacaaugaguuaugaaugcccaaugcuagaugaaggcguagaaccagaugacguagauuguuggugcaauacaaccucgaccuggguagucuacggaacaugucaccauaagaaaggagaagcaagaaggucaagacgagccgucacuuuaccuagccauucaacacgaaaacuacaaacaagaucacaaacauggcuagaaaguagagaauauaccaaacauuuaauaagaguagaaaauuggauauucagaaacccaggauucgcauuagcugcagcagcuauagcuuggcuauuaggcagcucaacaagucaaaaagugauauaucugguaaugauacuacuuauagcuccugcauacucaauuagauguauaggcguaucaaauagagauuuuguugaaggaaugagcggaggaacauggguagacauaguauuagaacacgguggaugugugacaguuauggcacaagauaaaccaacaguagauauugagcuaguuacuacaacaguaucaaacauggccgaaguaagaaguuacugcuacgaagcaucaauaagugauauggcaucagauagcagauguccaacccaaggugaagcauauuuagauaaacaaucagauacucaauauguuuguaaaagaaccuuaguagauagaggauggggaaauggauguggguuauuuggaaaaggaaguuuaguaacaugcgcuaaauuugccuguucgaagaaaaugacaggaaaaucuauucaaccagaaaaucuagaauaccgaauaaugcuuagcgugcauggaagucaacacagcggaaugauagucaacgauacuggacaugaaacggaugaaaacagagcaaaaguugaaauaacaccgaauagucccagagcagaggcaacauuaggaggauuugguuccuuaggacuagacugcgagccaagaacaggccuagauuucagcgauuuauauuaucuaacuaugaacaauaaacacugguugguccauaaagaaugguuucaugauauacccuuaccuuggcaugcuggugcagauacaggaacaccacauuggaauaauaaagaagcacuuguagaauuuaaagaugcacaugcaaaaagacaaacaguaguagucuuaggaucucaagagggagcaguacacacggcacuugcuggggcauuagaagcagaaauggauggagcuaaaggucgauuaaguaguggacacuuaaaaugccgauuaaaaauggacaaauuaagauuaaaaggaguaucauauucacuaugcacagcugcuuucacauuuacaaaaauaccagcugaaacacuacauggaacaguaacaguagaaguacaauacgcaggaacagauggaccguguaaaguaccagcacaaauggcaguggauaugcaaacacuuacgccaguaggaagauuaauaacagcuaaucccguaauuacugaaaguacagaaaauucuaaaaugaugcuagaacuagacccaccuuucggugauaguuauauaguaauaggaguaggagaaaagaaaaucacacaucauuggcaucgaucaggaaguacaauaggaaaagcauuugaagcuacaguaagaggcgcuaaacgaauggcaguucugggagauacugcaugggauuuuggaaguguaggaggagcacuaaacucauuaggaaaaggcauccaccaaauauuuggagcugcauuuaaaagucuauucggagguaugucaugguucagucaaauauuaauaggaacguuauugaugugguuaggcuuaaauacuaaaaacgguucaauuucacuaaugugucuagcacuaggaggaguauuaauauucuuaaguacggcaguaagugcaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9177 - RNA, 2320 nt, Artificial Sequence
  ZIKV prME variant mRNA Design 3 opt
gggagaaagcuuaccaugcggaaagaaaaaaaaagaagaggugcugauacaaguguaggaaucguaggacuauuauuaacaacagccauggcagccgaaguaacaaggagaggcuccgcauauuauauguaucuagaucgaaacgaugcuggugaagcaauaucuuuuccaacaacacuaggaaugaauaaauguuauauacaaauuauggaucuagggcauaugugcgaugcaacuaugaguuaugaaugcccaauguuagacgaggguguagaacccgaugauguugauuguugguguaauacaacaagcacauggguaguauauggaacaugccaccacaaaaaaggugaggcaagaagaagccgaagagcuguaacauuaccaucacauagcacuagaaaauuacaaacgagaagccaaacaugguuagaaucaagagaguacacuaagcaucuaauuagaguagaaaacuggauauuuagaaauccaggauucgcacuugcagcagcggcaauagcauggcuauuaggaucaucaacaagucaaaaaguaauauauuuaguuaugauacuuuuaauagcacccgcauauagcaucagaugcauuggaguaucaaauagagacuuugucgaagguaugucuggagguaccuggguagauauaguauuagaacaugguggauguguaacgguaauggcacaagacaaaccaacuguggauauagaacuaguaacuacaacaguaaguaauauggcagagguaagaucuuacugcuaugaagcaucaauaucagacauggcaagcgacucaagaugcccgacacaaggagaagccuauuuagauaaacaaucggacacgcaauauguuuguaaacgcacuuuaguagauagaggaugggguaauggaugugguuuauuuggaaaaggaagcuuaguuacaugugcuaaauucgcauguucaaaaaaaaugacaggaaaaucaauacaacccgaaaacuuggaauaucgaauaauguuaagcguacaugguucacaacacucagguaugauugucaaugacacaggucaugaaacagacgaaaacagagcaaaaguagaaauaacgccaaacucaccuagagcugaagcaacacuaggugguuuuggaucucugggacuagauugcgaaccaagaacaggacucgauuucagugauuuauauuacuuaacuaugaauaauaaacacuggcuaguccacaaagaaugguuucaugauauaccacugccauggcacgcaggugcagauaccgguacaccccauuggaauaacaaagaagcacuaguggaauuuaaagaugcacaugccaaacgucaaacagugguaguuuuaggaagucaagaaggagcaguccauacggcucuagcaggugcacuagaggcagaaauggauggggcuaaaggaagauuaucaaguggacauuuaaaguguagacuaaaaauggauaaauugagauuaaaagggguaaguuacucauuaugcacagcugcauuuacauucacaaaaauuccagcagaaacacuacauggcacaguaacaguagaaguccaauacgcaggaaccgaugguccguguaagguaccugcacaaauggcaguagacaugcaaacauuaacaccagucggccgacuaauaaccgcaaauccaguaauuacagaaaguacagaaaauaguaaaaugauguuagaauuagauccaccauuuggagauuccuacauuguuauaggaguaggugagaaaaaaauaacgcaucauuggcacagaaguggaaguacuauaggcaaagccuuugaagcuacaguaagaggggcgaaaagaauggcaguauuaggagauacagcuugggauuuuggaagugucggcggcgcacuuaauaguuuaggcaaagguauucaccaaauauuuggagcggcauucaaaucacuauucggaggaaugucuugguuuucucaaauauuaauaggaacauuacuaaugugguuaggacuaaauaccaaaaauggcuccauaucacucauguguuuagcauuaggagggguacuaauauucuuaagcacagcaguaucagcaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9178 - RNA, 2317 nt, Artificial Sequence
  ZIKV prME variant mRNA Design 3 opt
gggagaaagcuuaccaugaaagaaaaaaaaagaagaggagcagauacaaguguagguauaguaggauuguuacuaacaacagcuauggcagcagaaguaacaagaagaggaagugcauauuauauguaccuagauagaaaugaugcaggugaagcaauaaguuuuccaacaacauugggaaugaauaaauguuauauacaaauaauggauuuaggacauaugugugacgcuaccaugucauacgaauguccaaugcuagaugaaggaguagaaccagaugauguagacuguugguguaacacuacuucaacauggguaguauauggaacaugccaucauaaaaaaggagaagcaagaagaucaagaagagcaguaacacuaccaucacauucuacaagaaaauuacaaacacgaagccaaacauggcuugaaucacgagaauauacaaaacaucuaauacguguagaaaacuggauauuuagaaacccgggauucgcuuuagcagccgcugcaauagcauggcugcuagguucaucaaccucacaaaaagucauauaucuaguuaugauacuacuaauagcucccgcauacucaaucagauguauaggaguaagcaauagagauuuuguugaaggaaugucaggagguacauggguagauauaguguuagaacauggaggauguguaacaguaauggcgcaagauaaaccaacaguagauauagaauuaguaacaacuacaguaaguaacauggcugagguuagaaguuacuguuacgaggcgucuauaagcgauauggcaucagacaguagauguccaacccaaggugaagcauauuuagauaagcagagugacacacaauauguaugcaaaagaacguuaguugaucgaggauggggaaauggauguggauuauuugguaaaggaagucuaguaacaugugccaaauuugcauguaguaaaaaaaugacaggaaaaagcauacaaccugaaaaucuagaauauaggauaauguuaaguguacauggaagccaacacucuggcaugauuguaaaugacacaggucaugaaacggacgagaacagagcgaaaguagaaauaaccccgaauagccccagagcugaagcaacauuagggggauuugguagucuagguuuagauugugaaccaagaacaggguuagauuuuagugauuuauauuacuugacaaugaacaacaaacauuggcuaguacacaaagaaugguuucacgauauaccacuacccuggcaugcuggagcggacacagguacaccccacuggaauaauaaagaagcucuagucgaauuuaaagaugcacaugcaaaaagacaaacaguaguaguuuuaggaucacaagaaggagcaguacauacggcacuagcaggagcguuagaagcagaaauggauggggcuaaagggcgauuaucaucaggacacuuaaaaugucgauuaaaaauggauaaacuaagauuaaaaggaguaucauauaguuuaugcacagcagcauuuacuuuuacaaaaauaccagccgaaacacuucaugguacuguaacaguggaaguccaguaugcuggaaccgauggaccauguaaagugccagcgcaaauggcaguagauaugcaaacauuaaccccgguaggcagacuuauaacugccaacccuguaauaacagaaucaacggaaaacucaaaaaugaugcuugaauuagauccgccauuuggagacagcuacauuguaauagguguaggagaaaaaaaaauaacacaccacuggcauaggucaggaucgaccauugguaaagcguuugaagcaacaguacgaggagcuaaaagaauggcaguacuuggagacacagcuugggauuuugguucuguaggaggugcauuaaacagccuaggaaaaggaauacaucaaauauuuggagcagcuuuuaaaagucuauuugguggaaugaguugguuuagccaaauauuaauuggaacguuauuaaugugguuaggguuaaauacaaagaacgguaguauuagucuuaugugcuuagcuuuaggaggaguacuaauauuuuuaagcacagccguaucagcaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9179 - RNA, 2314 nt, Artificial Sequence
  ZIKV prME variant mRNA Design 3 opt
gggagaaagcuuaccauggaaaagaaaagaagaggggcggauacauccguaggaauaguuggacuauuauuaacaacugcaauggccgcagaaguaacacguagaggaucagcuuauuauauguaucuagauagaaacgaugcaggagaagcuauaaguuuuccaacaacacuaggaaugaauaaauguuauauacaaauaauggaccucggccacaugugugacgcuacaaugucuuaugaaugucccauguuagaugaaggagucgaaccagaugacguagauugcugguguaauacaacaucuacuuggguaguauaugguacaugucaucacaagaaaggugaagcaagaagaucacgaagggcaguaacuuuaccaucucacagcacuagaaaauuacaaacuagaagccaaacaugguuagaaucuagagaauauacaaaacauuuaauacgaguagaaaauuggauauuuagaaacccugguuuugccuuggcagccgccgcuauagcaugguuacuaggaucaucaacaagccaaaaaguaauauaccuaguuaugauacuacuaauugcaccagcauauucaauuagguguauaggaguuagcaauagagauuuuguagaagguaugucagguggaacauggguagacauuguauuagaacacggagguugugugacuguaauggcgcaagauaaaccaacaguagacauagaauuaguaacuacaacuguaaguaacauggcagagguaagaucguauugcuaugaagcaaguauaagugacauggcuucagauucaagauguccaacacaaggugaggcauaucuagacaaacaaucagacacacaauacguauguaaaagaacuuuaguagaccgcggcuggggaaacggaugcggacuauuugguaaaggaaguuuaguaacaugcgcaaaauucgcauguucuaagaaaaugacaggaaaaucaauacaaccugaaaaucuagaauauagaauaaugcuaaguguacauggaagucaacauucaggaaugauugugaacgacacuggacaugaaaccgaugaaaauagagcaaaaguagaaauaacaccaaauucgccaagagcagaagcaacucuuggggguuuuggaucauugggauuagauugcgagccuagaacaggauuagauuucagcgaucuuuauuacuugacaaugaauaauaaacauugguuaguacauaaagaaugguuccaugauauaccacuaccauggcaugcgggagcagauacugguacaccucauuggaacaauaaagaagcacugguagaguucaaagaugcccaugcaaaacgacaaacaguaguaguauuagggucacaagaaggagccguucacacagcacucgcuggcgcauuagaagccgaaauggauggcgcaaaaggaagauugucuucaggacaucuaaaaugccgauuaaaaauggacaaauuaagacuaaaagggguaagcuauucauuauguacagcggcauuuacauuuacaaaaauaccugcagaaacucuacauggaacaguaacaguggaaguacaauaugcagguacugacgguccuuguaaaguaccagcacaaauggcaguagacaugcaaacuuuaacaccaguagggagauuaauuacugcgaauccaguuauaacagaaaguacagaaaauucaaaaaugauguuagaauuagauccaccauucggagauagcuauauaguaauagguguaggagaaaagaaaauaacucaucacuggcacagaaguggauccacaauaggaaaagcauucgaagcaacaguaagaggcgcaaaaagaauggcaguauuaggcgacacugcaugggauuuugggucaguaggaggagcauugaauagucucgguaaagguauccaucaaauauuuggagccgccuuuaaaaguuuauucggaggaaugucuugguuuucucaaaucuuaauagguacacuacuaauguggcucggacuaaauacgaaaaauggcucgauaucacuaauguguuuagcucuaggagguguacuaauauuuuuaucaacagcagugagcgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9180 - RNA, 2311 nt, Artificial Sequence
  ZIKV prME variant mRNA Design 3 opt
gggagaaagcuuaccaugaagaaaagaaggggagcagauacaaguguaggaauaguaggacuauuacugacaacagcaauggccgcggaaguaacaagaagaggaucagcuuacuacauguacuuagaccgaaaugaugcaggagaagcaauaucguuuccaaccacauuaggaaugaauaaauguuauauacaaauaauggauuuaggacauaugugugacgcaacaaugagcuaugaaugcccaaugcuagaugaaggagucgaaccugaugauguagauuguuggugcaacacaacuagcacuuggguaguauacggaacaugucaccauaagaaaggugaagcuagacgaaguaggagagcuguaacauuacccagucauagcacaagaaaauuacagacaagaagccaaacaugguuagaaucaagagaauacacaaaacaccuaauaagaguagaaaauuggauauuuagaaauccaggcuucgcucuggcagcagcagcgauagccuggcuacuaggaaguucgacaagucaaaaaguaauauauuuaguuaugauuuuacugauugcuccagcauauaguauaagauguauaggagucaguaaccgagauuuuguagaaggcaugucaggaggaacauggguagauauuguauuagaacauggagguugugucacaguaauggcacaagacaaaccaacaguagauauagaauuaguaacaacuacaguaaguaauauggcagagguaagaucauauuguuaugaagcauccauaagugauauggcaucagauucaagauguccuacucagggagaagcauauuuagauaaacaaagugauacacaauauguauguaaaaggacauuaguagaccguggauggggaaauggauguggacuauuuggaaaaggaucauuaguuacaugcgcaaaauuugcauguucuaagaaaaugacagguaaaagcauacaaccagaaaauuuagaauaucgcauuaugcuaucaguucauggaucccaacauucagguaugaucgugaacgauacagggcaugaaacagaugaaaauagagcaaaaguagaaauaacaccaaacagcccaagagcagaagcaacuuuaggcggcuuuggaaguuuaggauuagacugugaaccaagaacagguuuagauuuuucagaucuauacuauuuaacaaugaacaauaaacauugguuaguccauaaagaaugguuucacgacauacccuuaccauggcacgcgggugcagauacagguacuccacauuggaacaacaaagaagcauuaguagaauuuaaggacgcucaugcaaaaaggcaaacugugguaguauuaggaucacaagagggagcuguucacacagcauuagcaggagcucuagaagcagagauggauggagcaaaaggaagauuaaguucgggacaucuaaaaugucgacuaaaaauggacaagcuaagauuaaaaggaguaaguuauagucuaugcacagcagcuuuuacauuuaccaaaauaccagcugaaacgcuacaugggacaguaacaguagaaguacaauaugcagguacagaugggccuuguaaaguaccagcacaaauggcaguagauaugcaaacacuaacaccaguaggacgauuaauaacagcaaauccagugauuacugaaagcacagaaaacaguaaaaugaugcuagaauuagacccacccuuuggagacaguuauauaguaauaggcguaggagaaaagaaaauaacucaucacuggcauagaaguggaagcacaauaggaaaagcauuugaagcaacaguuagaggagcaaaacgaauggcugugcuaggagauacagcuugggauuuuggcucaguaggaggggcauuaaauucauuagguaaaggaauacaucaaauauucggugcagcauuuaaaagucuauuugguggaaugaguugguuuucacaaauauuaauagguacucuacuaaugugguugggauuaaacacgaaaaacggaucaaucagucuaaugugccuagcgcuugggggcguguuaauauuuuuaaguacagcaguaagugcaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9181 - RNA, 2308 nt, Artificial Sequence
  ZIKV prME variant mRNA Design 3 opt
gggagaaagcuuaccaugaaaagacguggagcugauacaagugucggcauuguaggucuguuauuaacaacagcaauggccgcagaaguaacaagaagaggaucagcauauuauauguauuuagauagaaaugaugccggagaagcaauaucuuuuccuacaacauuagggaugaauaaaugcuauauucaaauaauggauuuagggcacaugugugaugcaacgaugaguuacgaaugcccaauguuagaugaaggaguagaaccggacgauguagauuguugguguaacacuacaucaacauggguuguuuacggaacaugucaucauaagaaaggagaagcaaggagaagucgcagagcagucacauuaccuagucacucaacaagaaaauuacaaacaagaagucaaacaugguuagaaaguagagaauauaccaaacaucuaauaagagucgaaaauuggauuuuuagaaacccgggauucgcacuggcagcagcugccauugcauggcuccugggaucaaguacgucacaaaaaguaauauauuuaguaaugaucuuauuaaucgcaccggcauacucaauuagauguauaggaguaagcaacagagauuuuguagaagggaugucagguggaacauggguagauaucguauuagaacauggcgggugugucacaguaauggcacaagauaaaccuacaguugauauagaauuagugacaaccacaguuaguaauauggcagaaguacgaucauauuguuaugaggcuuccauaucagacauggcaagugacucacgaugcccaacucaaggagaagccuauuuagacaaacaaucugauacacaauacguaugcaaaaggaccuuagucgacagagguuggggaaauggaugcggacuauuugggaaagguagcuuaguaacaugugcaaaauuugcaugcucgaagaaaaugacaggaaaaagcauacaaccagaaaauuuagaauauagaauaauguuaagcguucauggaucacaacacaguggaaugauaguaaaugauacagggcaugaaacagacgaaaauagagcuaaaguagaaauaacuccaaacagcccaagagcggaagcaacauuaggaggauuuggaaguuuaggacuagauugcgaacccagaacaggacuggacuuuagcgaccuauauuauuuaacaaugaauaauaaacauuggcugguucauaaagaaugguuucaugauauuccuuuaccguggcaugccggugcagauacagguacaccacauuggaauaacaaagaagcacucguagaauuuaaagaugcacaugcaaaaagacaaacaguaguagucuuaggaucccaagaaggagcaguacacacugcucuagcgggagcccuagaagcagaaauggacggcgcuaaaggaagauuaucuucaggacaucuaaaauguagacuaaaaauggauaagcuaagauuaaaaggcguaucuuauagccuauguacugcagcuuuuacauuuacaaaaauaccagcagaaacuuuacauggaacaguaacaguagaaguacaauacgcaggaacugacggaccaugcaaaguucccgcacaaauggcagucgacaugcagacacuaacaccaguuggaagauuaauaacagcaaauccaguaauaacagaaucaacagaaaauucuaaaaugaugcuugaauuagacccgcccuucggagauucauauauaguaauugguguaggagaaaagaaaauaacccaucacuggcacagaaguggauccacaauagguaaagcauuugaagcaacaguaagaggugccaaaaggauggcaguccuaggagauacagccugggauuuuggaaguguugguggggcacuuaacaguuuaggaaaaggaauacaucaaauuuuuggagcagcauucaaaagucuauucggaggaaugaguugguuuucacaaauacuaaucggaacacuauuaaugugguuaggauuaaauacuaaaaacggaagcauaucauuaaugugucuugcauuaggcggagugcuaaucuuuuuaagcacagcaguaagcgcaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9182 - RNA, 2305 nt, Artificial Sequence
  ZIKV prME variant mRNA Design 3 opt
gggagaaagcuuaccaugagaaggggugcggauacaucuguaggaauaguaggauuauuauuaacaacggcaauggcagcagaaguuacaagaagaggaagugcuuacuacauguauuuagauagaaacgaugcuggugaagccauaaguuucccaacuacauuaggaaugaacaaaugcuacauccaaaucauggaccuuggacauaugugugaugcuacaaugucauacgaauguccaaugcuggaugaagguguagaacccgaugauguagacuguugguguaacacaacaucuacuuggguuguuuaugguacgugucaccauaagaaaggugaagcaagacgaucaagacgagcaguaacauuacccagucacucaaccagaaaacuacaaacaagaucacaaacaugguuagaaucaagagaauauacaaaacaucuuauaagaguagaaaacuggaucuuuagaaacccuggauuugcauuagcagcagcagcuauagcaugguuacuagguucgaguacaagucaaaaaguuauuuaucucguaaugauacuauuaauagcaccagcuuauagcauaagauguauagguguaucaaauagagauuuuguagaagggaugucaggagggacauggguagauaucguauuagaacauggaggauguguaacagucauggcgcaagacaaaccaacaguugauauagaauuaguaacaacaacaguuuccaauauggcagaaguuagaucauauuguuaugaagcuagcaucucagauauggcuuccgacucaagauguccaacacaaggagaagcauauuuagacaaacaaucugauacacaauauguauguaaaagaacucuaguagauagagguuggggaaaugguuguggauuauuuggcaaaggaucuuuaguuacaugcgcaaaauuugcauguaguaagaaaaugacaggaaaaagcauucaaccugaaaauuuagaauauagaauaaugcuaucaguacacggaagucaacauagcgguaugauaguaaacgauacaggacaugaaacagaugaaaacagagcaaaaguggaaauaacaccaaacucaccuagagcagaagcaacauuaggcggauuugguaguuuaggauuagacugugaaccaagaacaggguuagauuuuagugauuuguauuauuuaacaaugaauaacaaacauuggcuaguacauaaagaaugguuccacgauauaccauuaccguggcaugcaggggcagauacuggaacuccccauuggaacaauaaagaagccuugguagaauuuaaagacgcacaugcaaaacgacaaacagucguaguauuaggcucacaagaaggcgcaguacauaccgcuuuagcaggcgcuuuagaagcagaaauggauggagccaaaggaaggcuaucaucuggucaucuuaaauguagacuaaaaauggauaaacuaagacuaaaaggaguuucuuacagucucuguacagcagcauuuacauucacgaaaauaccagcugaaacacuacauggaacuguaacaguagaaguacaauaugcaggaaccgauggaccauguaaaguaccagcacaaauggcaguugauaugcaaacauuaaccccaguagggagacuaauaaccgcaaauccaguuauuacagaaucaacagaaaacaguaaaaugaugcuagaauuagaucccccuuuuggcgauucauacaucguaauaggugugggagaaaagaaaauaacgcaucacuggcaucgaucaggaagcacaauaggaaaagcauuugaagcuacagucagaggagcuaaaagaauggccguucuaggagacacugcuugggacuucggaucaguugguggagcauuaaauucucugggaaaaggaauacaucaaauauuuggugcagccuucaaaucacuauuugguggcaugaguugguucucacagauacuaauagguaccuuauuaauguggcuaggauuaaauacuaaaaacggaucaauaucauugaugugcuuagcccuaggaggaguuuuaauauuucuaagcacagcugucagugcaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9183 - RNA, 2302 nt, Artificial Sequence
  ZIKV prME variant mRNA Design 3 opt
gggagaaagcuuaccaugcgaggagccgauacaagcguuggaauaguugguuuauuauuaacaacagcuauggcagcagaaguaaccagacguggaucggcauauuauauguaccuagacaggaaugaugcaggagaagcaauaucuuuucccacaacuuuaggaaugaauaaaugcuauauacaaauaauggauuuaggacauaugugugaugcaacuaugagcuaugaaugcccuauguuggaugaagggguugaaccagaugauguagauuguuggugcaacacuacaucaaccuggguuguauauggaacaugucaucacaagaaaggagaagcucgcagaagcagacgagcaguaacacuaccuucacauagcacaagaaaacuacaaacacgaucucaaacaugguuagaaagcagagaauacacaaaacaccuaauaaggguagaaaauuggauauuuagaaacccaggguuugcauuagcagcagcggcuauagccuggcuauuaggaucuaguacaucacaaaaaguaaucuacuuagugaugauauuauuaauugcaccagcauacucaauaagauguauaggaguuagcaauagagauuucgucgaaggaaugucaggcggaacauggguagauauuguauuggaacauggaggaugcguaacaguaauggcacaagauaaaccuacuguagacauagaauuaguaacaacaacuguaagcaacauggcagaaguaaggucauauuguuacgaagcaaguauaucagauauggcaagugauucgagauguccaacacaaggcgaagcauauuuagacaaacaaucagauacacaauauguauguaaaagaacccuaguagauagaggauggggaaauggauguggucuauuuggaaaaggaaguuuaguaacaugcgcuaaauucgcaugcagcaagaaaaugacaggaaaaucuauacaaccagaaaauuuagaauacaggauaauguuaucaguccacggaagucaacauucaggaaugauagucaaugacacaggacaugaaacugacgaaaauagagcaaaaguagaaauaacaccaaacucaccaagagcagaagcaacacuagguggcuucgguucauuaggacuggacugugaaccaagaacaggauuagacuucagcgauuuauacuacuuaacuaugaauaacaaacauuggcuaguacauaaagaaugguuccaugacauaccauuaccuuggcaugcuggugcagauacuggaacaccacauuggaauaauaaagaagcgcuaguggaguucaaagaugcacaugcuaaacgacaaacaguaguaguauuaggcucacaagaaggagccguccauacagcacuugcaggagcacuugaagcagaaauggauggagcaaaaggaagauuaucgaguggccacuuaaaaugucgacuaaaaauggauaaacuaagauuaaaaggaguuucauauaguuuauguacagcagcauuuacauucaccaaaauuccagcagaaacauuacauggaaccguaacuguggaaguacaauaugcaggaacagauggacccuguaaaguaccagcacaaauggcagucgauaugcaaaccuuaacaccaguaggaagauuaaucaccgcaaacccugugauaacagaaucuacagaaaacaguaaaaugaugcuagaauuggauccuccauucggagauuccuauauaguaauaggaguaggagaaaagaaaauuacucaccacuggcacagaucagguagcaccauagguaaagcauuugaagcuacaguaagaggugcaaaaaggauggcuguauuaggcgacacagcaugggauuucggaucaguuggaggcgcuuuaaacucacucggaaaaggcauucaucaaauauuuggagcagcauuuaaaaguuuauuuggaggaaugucaugguuuucacaaauucuaauaggaacauuacuaauguggcugggucucaauaccaaaaacggcaguaucagcuugaugugucuagcauuaggaggcguacuaauauuccuaagcacagcaguaucagcuugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9184 - RNA, 2299 nt, Artificial Sequence
  ZIKV prME variant mRNA Design 3 opt
gggagaaagcuuaccaugggcgcagauacaaguguaggaauuguaggguuauuacuaacaacagcaauggcagcagaaguaacaagaagagguagugcauauuauauguaucuugauagaaacgaugcaggagaagcuauuucauuuccaacaacacuaggcaugaauaaauguuauauacaaaucauggauuuaggacacaugugcgaugcuacaaugaguuaugaauguccaaugcuagacgaaggcguugaaccagaugauguagauugcugguguaacacaacaaguacuuggguaguuuauggcaccugucaucacaagaaaggagaagcgcgaagaaguagacgagcaguaacauuaccaucacauagcacaagaaaauugcagacuagaagucaaacauggcuugaaucaagagaauauacaaaacauuuaauacgaguugaaaacuggauauuccgaaauccagguuuugcacuagcagcagcagcaauagcauggcuacugggaucaaguacuagccaaaaaguaauauauuuaguaaugauauuacuaauagcccccgcguacaguauaaggugcauagguguaucgaauagggauuuuguugaaggaaugagcggagggacuuggguggauauaguacuagaacauggagguuguguuacaguaauggcacaagauaaaccaacaguugacauagaauuagugacaacaacuguaagcaauauggcugaaguaaggagcuauugcuaugaagcaaguauaucagauauggcaagugauucaagauguccaacacaaggugaagcauacuuagauaaacaauccgauacucaauauguauguaaaagaacucuaguagaucgaggauggggaaacggauguggauuauuuggaaaagggaguuuaguaacaugcgcaaaauuugcauguaguaagaaaaugacaggaaaaucaauacagccagaaaaucuagaauaucggauaaugcuaucaguacaugguagucaacauucaggaaugauaguaaacgauacaggucacgaaacagacgaaaaucgagcaaaaguugaaauaacaccuaacaguccacgagcugaagcaacauuaggcggauuuggaucccuaggauuagacugugaaccgaggacaggacuagauuuuucagaucuauauuauuuaacaaugaacaauaaacauuggcuaguucauaaagaaugguuucaugauauaccauuaccauggcaugcuggugcagacacaggaacaccucauuggaauaauaaagaagcauuaguagaauuuaaagacgcacacgcaaaaagacaaacaguuguaguauuaggaagccaagaaggagcuguacauacagcacuugcuggagcacuagaagcugaaauggauggugcuaaaggcagauuaagcaguggucauuuaaaaugcagauugaaaauggauaaauuacgauuaaaaggaguaucauauuccuuaugcacagcagcauuuacauuuacaaaaauaccagcagaaacauuacauggaacaguaacaguagaaguccaauaugcaggaacagacggaccaugcaaaguaccagcacaaauggcaguugauaugcagacacuaacaccaguaggaagauuaauaacugcaaacccgguaauaaccgaaaguacagaaaauucaaaaaugauguuggagcuggauccaccauuuggggacucauacauaguaauuggcguaggagaaaagaaaauuacacaccacuggcaucgaaguggaagcacaauaggaaaagcauucgaagccacaguaaggggagcaaaaagaauggcaguauuaggugacacagcaugggacuucgguucaguaggaggugcuuuaaauaguuuagguaaaggaauacaccaaauauuuggagcagcauuuaaaucauuauuuggaggaaugaguugguuuucacaaauucugauaggaacguuacuaauguggcuuggcuuaaauacgaaaaauggaagcauuucauuaauguguuuagcgcuugguggaguuuuaauauuuuuaucuacugcaguuagcgcgugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9185 - RNA, 2296 nt, Artificial Sequence
  ZIKV prME variant mRNA Design 3 opt
gggagaaagcuuaccauggcagauacgucugucggaauaguuggauuacuacuaacaacugcaauggccgcagaagugacuagacgagguucggcguacuacauguaucuagacagaaaugaugcuggagaagccauaucauuuccaacuacauuaggaaugaauaaaugcuacauacaaauuauggaccuaggacauaugugugacgcaacaaugucauaugaauguccaauguuagaugaagggguagaaccagacgacguagauugcugguguaacacaacaucuacaugggugguuuacgguacaugucaucauaagaaaggugaagcaagacgcucaagacgagcaguaacacugccaucacauaguacaagaaaacuacaaacaagaucacaaacauggcucgaaucgagagaauacacaaaacaucuuauaagaguagaaaauuggauauucagaaaucccggcuucgcacuagcugcagcagcaauagcaugguuacuuggaaguucuacgagucaaaaaguaauauaucuaguaaugauacuucuaaucgcgccugcauauagcauaagguguaucggggucucaaauagagacuuuguagaaggaaugucaggaggaacauggguagauauuguguuagaacaugguggaugugucacaguaauggcacaagacaaacccacaguagacauagaauuaguuacuaccacaguaucaaacauggcagaaguucgaucguauuguuaugaagcauccauaagugauauggcaucagacaguagaugcccuacccaaggagaagcauauuuagauaaacaaagcgauacucaauacguauguaaaagaacccuaguagaucguggaugggguaacggaugugguuuauuugguaaaggcaguuuaguaacuugugcaaaguuugcauguucaaagaaaaugacagguaaaucuauacaaccggaaaaccuagaauaucgaauaaugcuaaguguacauggaucucagcauaguggaaugauaguaaaugacacagggcaugaaacagaugaaaacagagcgaaaguagaaauaacuccaaacagcccaagagcagaagcaacauuaggaggauuuggcagucuaggacuagauugugaaccaagaacuggauuagauuuuucagaucuuuacuacuuaacuaugaacaacaaacauugguuaguacacaaagaaugguuucaugacauaccgcuaccauggcacgcuggugcagauaccggcacaccucauuggaauaauaaagaagccuuaguagaauuuaaagacgcacaugcaaaaagacaaacaguaguaguacuaggaucacaggaaggagcaguacauacagcccuagcuggagcauuagaagcggaaauggacggagcuaaaggaagauugucaagcggacacuuaaaaugucgacuaaaaauggauaaacuaagacuuaaaggaguaucauauagcuuaugcacagcagcauuuacauuuacaaaaauaccggcagaaaccuugcaugggacuguaacaguagaaguacaauaugcagggacagauggcccauguaaaguaccagcacaaauggcaguagauaugcaaacccuaacuccaguaggaagauuaauaaccgcaaauccaguaauaacugaaagcacggaaaacucaaaaaugaugcuagaacuagauccaccauucggagacaguuauauaguaauaggcguaggagaaaagaaaauaacgcaccauuggcauagaagcggaaguacaaucggaaaagcauuugaagcaacaguaagaggcgcaaaaagaauggcaguacuaggagauacagcaugggacuuuggaucgguaggaggggcauuaaacaguuuagggaaaggaauacaucaaauauuuggagcagcauuuaaaucacuauucggaggaaugagcugguucucacaaauauuaauagggacauuauugauguggcuaggccuuaacacuaaaaauggaucaauaagucuaauguguuuggcauuaggcggaguacuaauauuuuuaucaacagcaguaucagcaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9186 - RNA, 2293 nt, Artificial Sequence
  ZIKV prME variant mRNA Design 3 opt
gggagaaagcuuaccauggauaccucaguuggaauaguaggacugcuauuaacaacagcuauggcugccgaaguaacaagaagaggaagcgcauacuauauguacuuagauagaaaugaugcgggagaagcaauaaguuuuccaaccacacuaggaaugaauaaauguuacauacaaauaauggaucuagggcauaugugugaugcgacaaugucauaugaauguccaauguuggaugaaggcguagaacccgaugauguagacuguugguguaacacaacaagcacauggguaguauauggaacaugucaucacaagaaaggagaagcacgaagaaguaggagagcaguuacauuaccaucacauaguacuagaaaauugcaaacuagaucacaaacaugguuagaaagccgcgaauauacaaaacauuugauaagaguagaaaauuggauuuuuagaaacccaggcuucgcacuagccgcagcagcaaucgcauggcuucuaggaagcucuaccucacaaaaaguaauauauuugguaaugauauuauuaauagcaccagcuuauaguauaagauguaucggaguaaguaauagagauuuuguagaaggaaugaguggaggaacauggguagacauagucuuagaacauggaggauguguuacaguaauggcgcaagauaaaccaacaguagauauagaauuaguaaccacaacaguaaguaauauggcagaaguaagaaguuauuguuaugaagcaagcauuagugauauggcaucagauagucgauguccaacacagggagaagcauacuuggacaaacaaagugacacucaguauguauguaagagaacauugguagauagaggaugggguaaugguuguggauuauucggaaaaggaucguuggucaccugugcaaaauuugcuuguagcaagaaaaugaccggaaaaucaauucagccagaaaacuuagaauauagaauaauguuaagcguucauggaagucaacauagcggcaugauaguaaaugauacaggacacgaaacagacgaaaacagagcaaaaguagaaauuacaccaaauaguccaagagcagaagcaacauuaggagguuuuggaucucuuggauuggauugugaaccaaggaccggacuggauuuuucagaccuauauuacuuaacaaugaauaauaaacauugguuaguacacaaagaaugguuucacgacauuccauuaccuuggcacgccggagcagauacugggacaccgcauuggaauaauaaagaagcauuaguagaauuuaaagacgcacacgcaaaacgacaaacaguaguuguucuaggaagucaagagggggcaguucauacagccuuagcaggggcacuagaggcagaaauggauggagcuaaaggaagacuaaguaguggacacuuaaaauguagauuaaaaauggacaaauuacgucucaagggagucuccuauagcuuguguacagcagcauuuacuuucacaaaaauaccagcagaaacuuuacauggaacaguaaccguagaaguacaauaugcaggaacagauggaccaugcaaaguaccagcacaaauggcagucgacaugcaaacacuaacaccaguagggagacuaaucacagcaaauccuguaauaacagaaucaacugaaaauagcaagaugauguuagaauuagauccaccauuuggagauucauacauaguaauuggaguaggugaaaagaagauaacacaucacuggcacagaaguggaucaaccauaggaaaggcuuuugaagcaaccguaagaggugcaaaacgaauggcuguuuuaggagacacagcaugggacuuugggucaguagguggagcauuaaauagucuaggaaaagguauucaucaaauauuuggagcagcuuuuaaaaguuuauucggaggaaugucaugguucagccaaauauugauaggaacuuuauuaauguggcuaggauugaauaccaaaaaugguaguauuagucuaaugugucuugcguuaggaggaguauuaauauuuuuaagcacagcaguaucagcaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9187 - RNA, 2290 nt, Artificial Sequence
  ZIKV (strain ZikaSPH2015) Polyprotein(108-794) mRNA Design 3 opt
gggagaaagcuuaccaugacaagcguaggaauaguuggauuauuacuaacaacagcaauggcagcugaaguaacuagaagaggaagcgcauauuauauguaccuagaucgaaacgacgcuggagaagcaauaucuuucccaacuacauuaggcaugaauaaaugcuauauacaaauaauggauuuaggacauaugugcgaugcaacaaugucauacgaaugucccauguuagacgaaggaguagaaccagaugauguagauuguuggugcaauacaacaucaacaugggucgucuauggcacaugucaucauaagaaaggugaagcacggagaagucgcagagcaguuacacuaccgucacauucaacaagaaaacuacaaacuagaucacaaaccugguuggaaaguagagaauauacaaaacaucuaauaaggguagaaaauuggauauucagaaaccccggauuugcuuuagcugcagcagcaauagcauggcuacuaggaaguagcacaucacaaaaaguaauauaucuaguaaugauacuacuaauagcgccagcguauaguauaagauguauaggaguaucuaaccgugauuuuguggaagggaugucagguggaacauggguagauauuguauuagaacauggaggauguguaacagucauggcgcaagacaaaccaacuguagauauagagcuaguaaccacaacuguaucaaauauggcagaaguuagauccuauugcuacgaagcaucgauuagcgauauggcaagugauuccagauguccaacccaaggagaggcuuacuuagauaaacaaagugauacacaauauguaugcaaaagaacauuagucgauagaggauggggaaauggaugcggguuauucggaaaaggaucuuuagugacaugugcaaaauuugcuuguucuaagaaaaugacaggcaaaucaauacaaccagaaaacuuagaauauagaauuauguuaucaguacacggaucacaacauagcggaaugauugucaaugauacaggacaugaaacagaugaaaauagagcaaaaguagaaauaacaccuaauucaccuagagcagaagcaacacuaggaggauucggaaguuuagguuuggauugcgaaccacgaacuggucuagauuuuucagauuuauacuauuugacaaugaauaauaaacauugguugguacauaaagaaugguuucaugacauaccacuaccuuggcaugcaggagcagacacuggaacaccacacuggaacaauaaagaagcacuugucgaguucaaagaugcacaugcuaaaagacaaacaguuguuguauuaggaagccaagaaggagcaguacauacagcauuagcaggggcguuagaagcagaaauggauggagcaaaaggcagacuuucuuccggacauuuaaaauguagauuaaaaauggauaaauuacgccuaaaaggugucucauacucauuauguacagcagcauuuaccuuuaccaaaauuccagcggaaacccuucauggaaccguaacaguugaaguucaauaugcuggcacagacggaccaugcaaaguaccugcacaaauggcaguagauaugcaaacucuaacuccaguugggagacuaauaacagccaauccaguuaucacagaaagcacagaaaauucaaagaugaugcucgaauuagauccgccauucggugacucuuauauaguuauaggaguaggugaaaagaaaauaacacaucauuggcaccguagcggaagcacuauuggaaaagcauuugaagcaacaguuagaggugcaaaaagaauggcaguacuaggagauaccgcaugggauuucggaagugucggcggagcacuaaauucauuagguaaagguauacaucaaauauuuggagcagcuuuuaaaagccuauuugguggaaugaguugguucucgcaaauauuaauaggaacccuuuuaauguggcuaggacuaaauacuaaaaauggaaguauaagccucaugugucuagcacuugggggaguauuaauauucuuauccacagcuguaucagcaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9188 - RNA, 2290 nt, Artificial Sequence
  ZIKV prME variant mRNA Design 3 opt
gggagaaagcuuaccaugacgucaguaggaauugucggauuauuauuaacuacagcaauggcagcagcuguaaccagaaggggaucagccuacuauauguauuuggaccgaaaugaugcuggugaagcaauaucauuuccaacuacauuagguaugaauaaaugcuauauacaaauaauggaucuuggacauaugugugaugcaaccaugaguuaugaauguccuauguuagaugaaggaguagaaccugaugacguagauugcugguguaacacaacuucaacauggguaguauauggaacaugccaucacaagaaaggagaagcaagacgaagccggagagcaguaacauuaccaagucacucaacgagaaaauuacaaacaagaucacaaacauggcuugaaaguagagaauacacuaaacauuuaauaagagucgaaaacuggauauuuagaaauccaggauuugcacuagcagcugcagccauugcaugguuauuaggaucaaguacaucucaaaaagucauuuacuuaguaaugauauuacucauagcuccugcauauucaaucagaugcauaggcguuucaaacagagauuucguagaaggaaugucagguggaacauggguagauaucguacuagaacacggaggaugcguuacaguaauggcacaggauaaaccaaccguagacauagaauuaguaacaacuacuguaaguaauauggccgaaguaagaucauauuguuaugaagccaguauuagcgauauggccagcgauagcagauguccaacgcaaggagaagcauacuuagauaaacaaagugauacucaauauguauguaaacgaacauuaguagaucgaggaugggguaacggaugcgguuuauuuggaaaaggaucauuaguaacaugcgcaaaauuugcaugcucuaagaaaaugacuggaaaaucaauacaaccagaaaaucuagaauacagaauaauguuaucgguacauggaagccaacauucaggaaugauaguaaacgacacuggacaugaaaccgacgaaaauagagccaaaguagaaauaacaccuaauuccccaagagcagaagcaacauuaggaggauucggaagccuaggacuagauugugaaccaagaacuggucuugacuucucagacuuauacuaccuaaccaugaacaacaaacacugguuaguacauaaagaaugguuccacgacauaccauuaccuuggcacgcuggagcagacacaggcacaccccacuggaauaauaaagaggcuuuaguugaguucaaagaugcucacgcuaaaagacaaacaguaguaguacuagguucacaagaaggugcaguacauacagcuuuagcaggagcacucgaagcagaaauggauggagcaaaaggaagauuaucaaguggacaucuaaagugcaggcuaaaaauggauaaguuaaggcuaaaaggaguaucauauucucuaugcacagcagcauuuacauucacaaaaauaccagcagaaaccuuacauggcaccguaacaguagaaguacaauaugcagguacagauggcccuuguaaagucccagcacaaauggccguagauaugcaaacauuaacaccagugggcagauuaauaacagcaaaccccguaauaacugaaaguacagaaaauaguaaaaugaugcuagaauuagauccuccauuuggcgauaguuauauaguaauaggaguaggagaaaagaaaauaacacaucacuggcaccgcagcggaaguacuauuggaaaagcauuugaagcaacuguaagaggagcaaaaagaauggcuguucuaggagacacagcuugggacuuugguucuguaggaggagcacuaaauaguuugggaaaaggcauacaucaaauuuuuggcgcugcauucaaaucacuauuuggaggaaugaguugguuuucacaaauucucauaggaacauuauuaauguggcuaggguuaaacacgaaaaauggaaguauaucauuaauguguuuagccuuagguggaguauuaaucuucuuaucuacagcaguaucugcuugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9189 - RNA, 2302 nt, Artificial Sequence
  ZIKV prME variant mRNA Design 3 opt
gggagaaagcuuaccaugcguggagcugauaccucaguugguauaguaggcuuacuauuaacaacagcaauggcugccgcuguuacuagaagaggaucagcauauuauauguacuuagauagaaaugaugcaggagaagcaaucucauuucccacuacuuuaggcaugaauaaauguuacauucaaauaauggauuuaggacauaugugugaugcaacaaugucauacgaaugcccaauguuagaugaaggcguagagcccgaugauguagauuguugguguaauacuacaucuacuuggguaguguauggaacaugucaucacaaaaaaggagaagcaagacgaagcagacgagcaguaacauugccaucucacucaacaagaaaauuacaaacaagaucacaaacauggcuagaaucuagagaauacacaaaacauuuaauaagaguagaaaauuggauauuuagaaauccaggauucgcguuggcggccgcagcgauagcaugguuauuaggaucaaguacaucacaaaaaguuaucuauuuaguaaugauccuacuaauagcaccagcguauaguauuagauguauaggcguaucaaauagagauuucguagaggggaugagugguggaacauggguagauauaguuuuagaacaugguggguguguaacgguaauggcucaagauaaaccaaccguagauauagaguuagucacaacuacagucagcaauauggccgaaguaagaucauacuguuaugaagcaucaaucucagauauggccagugacaguagauguccaacucaaggagaagcuuaucucgacaaacaaagugauacacaauauguauguaaaaggacacuaguggauagagguugggguaaugguuguggacucuuuggcaaagguagucuagucacgugcgcuaaauuugcuugcucaaaaaaaaugacgggaaaaagcauacaaccugaaaauuuagaauaccgaauaauguuaucaguucauggcagucaacauagcgggaugauaguuaacgauacaggacaugaaacagaugaaaauagagcaaaaguggaaauaacaccuaacucaccuagagcggaagccacguuaggaggauuuggaaguuuaggauuagauugcgaaccaaggacaggauuagauuucucagauuuauauuaucuaacuaugaauaacaaacacugguuaguacauaaagagugguuccacgauauuccacuaccauggcaugcuggggcagacacuggaacaccucauuggaauaauaaagaagcauuaguagaauucaaagacgcacaugcuaaaagacaaacuguagugguacuaggaagucaagaaggagcaguacauaccgcacuugcuggagcacuagaagcagaaauggauggugcaaaaggaagacuuucaaguggacaucuaaaauguagauuaaaaauggacaaauuaagauuaaaaggaguaucauacucauuauguacagcagccuuuacauucacaaaaauaccugcagaaacacuucauggaacaguaacaguagaaguacaauaugcuggaacugauggcccguguaaaguucccgcucaaauggcaguugauaugcaaacauuaaccccugucgggagauugauaacagcuaauccaguuauaacagaaucuacugaaaacucaaaaaugauguuagaauuagacccaccauucggagauagcuauauaguaaucgggguaggugaaaaaaaaauuacacaccauuggcacagaaguggaucuacaauaggaaaagcauuugaagccacuguuagaggagcaaaacgaauggcaguacuaggugacaccgcaugggauuuuggaucagucggcggugcauuaaacucacuaggaaaaggaauccaucaaauauuuggagcugcauuuaaaagccuauuugguggaaugucaugguuuagccaaauacuaauuggaacuuuauuaauguggcuaggauuaaauacaaaaaauggaucaauuagcuuaauguguuuagccuuaggaggaguuuuaauauucuuaagcacagcuguaagugcaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9190 - RNA, 2326 nt, Artificial Sequence
  ZIKV prME variant mRNA Design 3 opt
gggagaaagcuuaccaugagaggacuaucuagcagaaaaagaagaucacaugacguauuaaccguucaguucuuaauauuaggaauguuauuaaugacaggaggaguaacaagacguggcuccgcguauuauauguaccuagauagaaaugaugcaggagaagcaauuucauuuccuacaacuuuaggaaugaauaaaugcuauauacaaaucauggaccuaggacauaugugcgaugccacaaugagcuaugaauguccaauguuagaugaaggcguagaaccagaugacgucgauugcugguguaacacaacuucaaccuggguaguauauggaaccugucaucauaagaaaggagaagcaagacgaucaaggcgagcaguaacauuaccaucucacucaacaagaaaauuacagacaagaucacaaacauggcuagaaaguagagaauauacaaaacauuuaauaagagucgaaaauuggaucuuucguaauccugguuuugcacuagcugcagcugcuauagcuugguuauuaggcucaagcacaucacaaaaaguuauuuacuuaguaaugauauuacuaauagcaccagcuuacucaauaagauguauagguguuuccaacagagauuuuguagaagguaugucuggaggaacuuggguugauaucgucuuggagcaugguggauguguaacgguaauggcucaagauaaaccuacaguagauauagagcuaguuacgacaacaguuagcaauauggcugaaguccgaaguuauugcuacgaagcaagcauaagugauauggcaagugauucaagaugcccaacacaaggagaagcauaucuagauaaacaaagugacacacaauacguuuguaaaagaacucuuguagauagggguuggggcaauggaugugguuuauucggaaaaggaaguuuaguaacaugugcuaaauuugcuuguucuaagaaaaugacuggcaaaucaauucaaccagaaaauuuagaauacagaauaaugcuaucaguucaugguucacaacauucuggaaugauaguaaaugauacaggacaugaaacagaugaaaaucgugcuaaaguagaaauuacaccaaacucaccaagagcagaagcaacucuugguggauuuggcucauugggguuggauugcgaaccaagaacuggauuagauuucagugauuuguauuauuuaacuaugaauaauaaacacuggcuaguucauaaagagugguuccacgacauaccauuaccauggcacgcaggagcagauacaggaacaccacauuggaacaauaaagaagcacucguugaauuuaaagaugcacaugcaaaaagacaaaccgugguaguauugggaucucaagaaggagcaguucacacagcacuagcaggagcauuagaagccgaaauggacggagcaaaaggaagguuaucuucagggcaucuaaaauguagauuaaaaauggacaaacuaagauuaaaagggguaaguuauucacuauguacagcagcuuuuacauucacaaaaauaccugcagaaacacugcacgggacaguaacaguagaaguacaauaugcaggaacagaugguccauguaagguacccgcacaaauggcaguugacaugcaaacucuaacgccaguaggaagacuaaucacagcuaauccaguaauaacagaaucaacugaaaacucaaaaaugaugcuagagcucgauccaccuuucggagauucauacauugugauagguguuggagaaaagaaaauuacacaucauuggcauagaucaggaucaacuauaggaaaagcauuugaagccaccguaagaggagcaaaaagaauggcugugcuaggagauacugccugggauuuuggaaguguaggaggagcauuaaauucacuagggaaaggaauacaucaaauauuuggagcagcauuuaaaucacuauuuggugguaugagcugguuuucacaaauucuaauaggaacauuauuaaugugguuaggucuaaacacuaaaaacggaagcauaucuuuaaugugccuagcacuaggugggguacucauauuucuaagcacugcugugagugcaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9191 - RNA, 2326 nt, Artificial Sequence
  ZIKV prME variant mRNA Design 3 opt
gggagaaagcuuaccaugagaggguuaucaagucgaaaaaggagaucacaugauguuuuaacaguacaauuuuuaauuuugggcaugcuacuuaugacuggagcaguaacaaggagaggaagugccuauuauauguaucuugauagaaaugaugcaggagaagcaauuucauuuccaacaacauuaggaaugaauaaauguuauauacaaauaauggauuuaggacacaugugugaugcaacaaugucauacgaauguccaaugcuagaugaagguguggaaccugaugauguagauugcugguguaacacaacaagcacuuggguaguauacggaacaugucaccacaagaaaggggaagcaagaagaaguagaagggcaguuacccuaccaagccauucaacaagaaaauuacaaacaagaucacaaacauggcuagaaaguagagaauacacaaaacacuuaauaagaguagaaaacuggaucuuuagaaauccaggauucgcacuagcagcugcugcuauugcuuggcuauuaggaagcaguacuagccaaaagguaauauaucuuguuaugauauuacuaauagcaccagcauacucaauaaggugcauaggaguaucaaauagagauuuuguagaaggaauguccggagguacauggguggauauuguacuagaacauggcggcugcgucacagugauggcacaagacaaaccaacaguagauauagaauuaguuacaacaacagucucgaauauggcagaaguaagaaguuauuguuacgaagcaagcauaagugauauggcaagcgacagucggugcccuacucagggagaagcauauuuagauaaacaaucagauacccaauacguauguaaacgaacucuaguagacagaggguggggaaauggauguggacuauuugguaaaggaucacugguaacaugcgcaaaauuugcaugcaguaagaaaaugacaggcaaaaguauucaaccugaaaauuuggaauauagaauaaugcuuagcguacauggaucacaacacucaggaaugauagugaaugauacaggacacgaaacagaugaaaauagagcaaaaguagaaauaacaccuaauaguccuagagcggaagcaacacuaggaggauucggaucauugggucuugacugugaaccacgaacuggguuagauuuuucagaucuauauuauuuaacaaugaauaauaaacauugguuaguacacaaagagugguuccaugauauaccauugccauggcaugcaggagcggauacuggaacaccgcauuggaacaacaaagaagcacuuguagaauuuaaagaugcacaugcaaaaaggcaaacaguaguaguacuuggaucucaagaaggagcaguacauacugcuuuagcaggagcauuagaagcugaaauggauggagcaaaagguagacuaagcucgggacacuuaaaaugcagacuaaagauggauaaauuaagauuaaaaggugugucguacaguuuauguacagcugcauuuaccuuuacuaaaauaccagcagaaacauuacauggcacuguaacaguugaaguacaauaugcaggaaccgaugguccaugcaaaguaccagcucaaauggcaguagauaugcaaacgcuuacuccaguaggaagguuaauaacagcuaauccaguaauaacugaauccaccgaaaauagcaaaaugauguuagaauuagauccaccauuuggggauucauauauaguuauaggaguaggagaaaagaaaauaacucaccauuggcacagaucaggaaguacaauaggaaaagcguucgaagcaacaguaaggggagcaaaacgaauggcaguauuaggagacacagcaugggacuuugguucaguaggcggagcauugaauagcuuaggaaaaggaauacaccagauauuuggcgcagcuuucaagagcuuauuuggaggaaugucgugguuuagccaaauacuaauaggaacuuuauugauguggcuaggacugaacacuaaaaacggaaguauuucauuaauguguuuagcauuaggaggaguauuaaucuuuuuaucaacagcaguaagugcuugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9192 - RNA, 2365 nt, Artificial Sequence
  KU321639.1 prME-long mRNA Design 3 opt
gggagaaagcuuaccaugcguauaauaaaugcaagaaaagaaaagaaaagaagaggcgcagauacaagcguaggcauaguuggguuacuguuaacaacagcuauggcugcagaaguaacaagaagagguagcgcuuauuacauguauuuagacaggaaugacgcuggagaagcaauuagcuuuccaacaacuuuaggaaugaauaaauguuauauucaaauaauggaucuaggacacaugugcgacgcaaccaugaguuaugaauguccaaugcuagacgaaggaguagaacccgaugauguugauuguugguguaauacaacgucaaccuggguuguauauggcacaugucaucauaagaaaggagaagcaagaagaaguaggagagcaguaacacuaccuucacauucaacuagaaaacuacaaacucguagccaaacauggcuagaaucacgagaauauacaaaacaucugauaagaguagaaaauuggauuuuuagaaauccuggauuugcucuagcugcagccgcaauagcauggcuacuaggaucuaguacuagccaaaaagugauauacuuaguaaugauauuacuaauagcuccugccuacaguauacgcugcauaggaguaagcaauagggacuucguagagggaaugucaggaggcacauggguagauauaguacuagaacacggaggauguguaacaguaauggcccaggauaaaccaacuguagauauugagcuaguaacuacaacuguaucaaacauggcugaagucagaaguuacuguuacgaagcaaguauaagugauauggccucagauucacgauguccaacucaaggagaagccuaucuagauaaacaaucagauacucaauauguauguaaaagaacuuuaguagauagaggcuggggaaauggcuguggauuauuuggaaaaggcagcuuagucacaugcgcaaaauuugccugcagcaagaaaaugacgggaaaaucgauacaaccggaaaauuuagaauauagaauaauguuaucaguacacgggagccaacauucaggaaugauaguaaaugauacaggacacgaaacggaugaaaauagagccaaaguugaaauaacaccuaacaguccaagagcagaagcuacacuagguggauucggcucauuaggauuggauugugaaccacgaacuggcuuagacuucucugacuuauacuacuuaacuaugaauaauaaacauuggcuaguacauaaagaaugguuccaugacaucccuuuaccauggcaugcaggagcagauacaggaacaccucauuggaauaauaaagaagcacuuguagaguucaaagaugcacaugcuaaaagacaaacaguaguaguauuaggaucacaagaaggugccguacacacugcgcuagcuggugcauuagaagcggaaauggauggagccaaaggaagacuaucuuccggacaucuuaaauguagauuaaaaauggauaaacuaagauuaaaaggaguaagcuauaguuuaugcacagcagcuuuuacauuuacaaaaauaccggcagaaacauuacauggaacaguaacaguugaaguucaauaugcgggaacggauggaccuugcaaagucccagcccaaauggcuguggacaugcaaacauuaacgccaguaggaagacucauuaccgcaaauccaguaauaacugaaucaacggaaaacaguaaaaugaugcuagaacuagacccuccauuuggagacagcuauauaguaauaggaguaggagaaaagaaaauaacacaucauuggcaucgaucuggaaguaccaucggaaaagcauuugaagcgacaguacgaggagccaaaagaauggccguauuaggcgauacagcuugggauuucgguucggucggaggcgcauuaaauaguuuaggaaaaggaauacaucaaauuuucggagcagcauucaaaagccuauuugggggcaugagcugguuuucacaaauacucaucgguacuuuauuaauguggcuaggacucaauacgaaaaaugguaguaucucauuaauguguuuagcauuaggcggaguauugauuuuucuuaguacagcaguaagugccgacguaggaugcucaguagauuucaguaaaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9193 - RNA, 2365 nt, Artificial Sequence
  KU312312.1 prME-long mRNA Design 3 opt
gggagaaagcuuaccaugagaauuauaaacgcuagaaaagagaaaaagcguagaggagcugauacaagcguugggauaguagguuuguuacuaacaacagcaauggcagcagaaguuacaagaagagggagugcauauuacauguaucuagacaggaacgaugcuggugaagcaauuucauucccaacaacauuaggaaugaauaaauguuauauacaaauaauggacuuaggacacacaugcgaugcaacaaugucauaugaguguccgauguuagaugagggaguagaaccagaugacguagauuguugguguaauacaacaaguacaugggucguguauggaacaugccaccauaagaaaggagaagcaagaagaaguagacgagcaguaacauuaccaagucacaguacaagaaaacuacaaacuagaagucaaacaugguuagaaucuagagaguauacaaaacacuuaaucagaguagaaaauuggauauuuagaaauccaggauuugcauuagcagcugcggcaauagcuuggcuauuaggaagcucaacaucucaaaaaguaauauauuuaguaaugauacuauuaauagcaccagcuuauagcauaagguguauuggaguaucaaauagagauuucguugaaggaaugucaggaggaacauggguagauguuguucuagaacauggagguugcguuacagucauggcacaagauaaaccaacaguagauauagaauuagucacaacaacaguuaguaacauggcagaaguacgcucauauuguuaugaagcaagcauaagcgauauggcaucagauucaagauguccaacacaaggagaagcauauuuagauaaacaaucugacacacaauauguauguaaacguacguuaguagaccguggaugggggaacggauguggauuauuugguaaaggaucguuaguaacaugcgcaaaauucgcaugcaguaagaaaaugaccggaaaaagcauacaacccgagaacuuagaauauagaauaauguuaagcguacauggcagccaacauaguggaaugaucgucaacgauacaggacaugaaacagaugaaaauagagcuaaaguagaaauaaccccaaacagcccaagagcagaagcaacauuagguggauuugguucacuaggauuagauugcgaaccuagaacgggccuggauuuuagugaccuauacuauuuaacaaugaauaauaaacacugguuaguucauaaagaaugguuucaugauauuccucuaccauggcaugcaggcgcagauacagguacaccacacuggaacaauaaagaagcauuaguagaguucaaagaugcacacgcaaagagacaaacugucgugguacuagguagucaagaaggugcaguucauacagcacucgcaggagcguuagaagcagaaauggauggagcgaaaggaagauugaguucaggucaucuaaaaugccgacuaaaaauggauaaauuaagguuaaaagguguaucauauucauuaugcacagccgcuuucacauuuacaaaaaucccagcagaaacuuuacauggaacaguaacuguagaagugcaauaugccggaaccgauggaccaugcaaagucccugcucaaauggcuguagacaugcaaacauuaacgccaguuggaagacuaauaacagcaaaccccguaauaacggaaagcaccgaaaacagcaaaaugaugcuagaauuagauccaccuuuuggagacaguuauaucguuauaggcguaggcgaaaagaaaauuacccaucauuggcauagaaguggaagcacaauuggcaaagcauucgaggcaacaguaagaggcgccaaaagaauggcugucuuaggagacacagcaugggauuuuggaagugucggaggagcauuaaauagccuuggaaaaggaauacaucaaauauuuggggcagcauucaaaucacuauuuggaggaaugagcugguuuucacaaauuuuaauagguacccuauuaaugugguuaggacuaaaugcuaaaaauggaaguauaaguuuaaugugucuugcauuaggaggaguauuaauauuucuaucaacggcuguaucagcugauguaggauguaguguagacuuuucaaaaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9194 - RNA, 2353 nt, Artificial Sequence
  AY632535.2 prME-long mRNA Design 3 opt
gggagaaagcuuaccaugagaauaaucaacgcucgaaaagaacgaaaaagaagaggagcagauacuaguauuggcauaauaggucuauuacuuacuaccgcuauggcagcugaaauaacaagaagaggaagcgcauacuacauguauuuagauagaagugaugcaggaaaagcaauuucuuuugcaacgacauugggaguaaauaaaugccacguucaaauaauggaucuaggacauaugugugaugcuacuaugucauacgaauguccgauguuagaugaaggaguagaaccagacgacgucgauuguugguguaauacaaccagcacauggguaguguacggaacaugccaccauaaaaaaggagaggcaagacgaagcaggcgagcaguaacauugccgagucacucaacaagaaaacuacaaacuaggucacaaacaugguuagaaaguagagaauauacaaaacauuuaauaaaaguggaaaauuggauauuuagaaauccaggauucgcucuaguugcuguggcaauagcuugguuauuagguaguaguacuagucaaaaagucauauaucuaguuaugauucuacugauagcaccagccuauucuauaagauguauaggaguaucuaacagagacuuuguagaagguaugucgggaggaacuuggguagauguaguacuagaacauggagguuguguaacggucauggcacaagauaaaccuacuguagacauagaauuaguaacaaccaccguaucgaacauggcagaaguaagaucuuauugcuaugaagcaaguauuagcgauauggcaagcgacucaagaugcccuacucaaggagaagcauacuuagacaaacaguccgauacucaauauguguguaaaagaacuuuaguagauagaggauggggaaacggcuguggacuauuuggcaaaggaucauuagugacaugugcaaaauuuacauguagcaaaaagaugacagguaaaaguauacaaccagaaaauuuagaauacagaauaauguuaaguguacauggcucucaacauagcggaaugauaggauaugaaacagaugaggauagagcaaaaguagaaguaacaccuaauaguccucgugcagaagcaacucuggguggauucggaagccuaggauuggauugugaaccacgaacaggauuagauuuuagugaucuauauuacuuaacaaugaauaauaaacauuggcuaguccauaaagaaugguuucaugacauuccauuaccauggcacgcaggugcagauaccggaacaccacacuggaauaauaaagaagcuuuaguagaauuuaaagacgcgcaugcaaagaggcaaacggugguaguauugggaucacaagagggagcaguacauacagcucuagcaggagcacuugaagcagagauggacggugcaaaaggaagauuauuuucaggacacuuaaaauguagacucaaaauggauaaauuaagguuaaaaggagucagcuauagcuuaugcacagcagcauuuacauucacaaaaguaccagcagagacauuacaugggacaguuacaguugaaguacaauaugcgggaacagauggaccauguaaaauacccgugcaaauggcaguugacaugcaaacauuaacaccuguaggaagauuaauuacagcgaacccaguaauaacagaaucuacagaaaauaguaaaaugauguuagaacuagacccaccauuuggagauaguuauauagugauaggagugggugauaaaaaaaucacacaucacuggcauaggaguggaucuacuauuggaaaagcuuuugaagcaacaguaagaggagcaaaaagaauggcaguuuuaggagauacagcaugggauuucggaagcguaggagggguauuuaauagccuagggaaagguauucaucaaauauuuggagccgcauuuaaaagucuauucgguggaaugaguugguucucacagauauuaauaggaacauuauuagucugguuaggauuaaauacaaaaaaugggucaauaucucugacaugucuagcacuagguggaguaaugauauuucuaaguacagcaguaagcgcagaugucggauguagcguagacuuuucgaaaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9195 - RNA, 2365 nt, Artificial Sequence
  KU527068.1 prME-long mRNA Design 3 opt
gggagaaagcuuaccaugagaauaauaaaugcgagaaaggaaaaaaaacgacgaggagcagauacaucaguuggaauaguaggcuuauuauuaacaacggcaauggccgcagaagugacaagaagaggaagugcauauuacauguauuuagauagaaacgaugcuggagaagcuauaucuuuuccaaccacauuaggaaugaauaaauguuacauacaaauaauggauuuaggucauaugugugaugcuacaaugucauaugaguguccaauguuagaugaagguguagaaccugaugacguagauuguuggugcaacacaacaaguacauggguaguauauggaacaugucaucauaaaaaaggagaagccagaagaagcagacgugcuguaacauuacccucacauagcacaagaaaacuacaaacccgaagucaaacgugguuagaaucuagagaauacacaaaacaucuuauaagaguagagaauuggauauuuagaaauccugguuucgcauuggcagcagcagcaauugcguggcuacuaggaucgucuacaagucaaaaaguaauauacuuaguaaugauauuacuuauagcgccugcauauaguauaagauguauaggaguaagcaauagagauuuuguagaagguaugucaggggguacguggguagauguaguauuagaacaugguggaugcgucacaguaauggcacaagacaaaccuacaguagauauugaacuaguaacaacaacaguaucaaauauggccgaaguaagaucauauuguuaugaagcaucuauaagugauauggcuagugacaguagauguccaacacaaggugaagcauaucuagauaaacaaagcgauacacaauauguguguaaaagaacauuaguagauagaggaugggguaacggaugugguuuauuuggaaaaggauccuuaguaacgugugcaaaauuugcuuguagcaaaaaaaugacaggaaaaucaauccaaccagaaaauuuagaauauagaaucauguuguccgugcaugguagucaacacucuggaaugauuguaaaugauacaggacaugaaaccgaugaaaauagagcaaaaguugaaauaacaccgaauagcccaagggcagaagccacauuaggaggauuuggcucguuaggucuagauugugaaccaagaaccggauuagauuuuagugaccuauauuaucuaacuaugaacaacaaacacugguuaguucacaaagaaugguuucacgauauacccuuacccuggcaugcuggggcagacacagguacaccacauuggaauaauaaagaagcacuuguagaauucaaagacgcucaugccaagagacaaacuguaguugugcucgguagucaggaaggugcuguacacacagcacuugcaggagcacuugaagcagaaauggauggagcaaaggguagauuaucuaguggucauuuaaaauguagauuaaaaauggacaaauuaagauuaaaaggcguaaguuauucacuauguacugcagcauuuacauuuaccaaaauaccagcagaaacacuacauggaacugucacaguagaaguacaguaugccggaacagaugguccauguaaagugccggcucaaauggcaguugauaugcaaacauuaacaccaguaggaagauuaauaacagcaaauccgguuauuacagagucuacggaaaauucgaaaaugaugcuugaacuagacccaccauucggugacaguuacauugucauugguguaggugaaaaaaaaauaacacaccauuggcauagaucaggaaguacaauaggaaaagcauuugaagcuacagugagaggagcgaaacgaauggcaguacucggugauacagcaugggauuuuggaucuguagguggagcauuaaauaguuuaggaaaagguauacaucaaauauuuggagcagcuuuuaaaucacuauuuggaggaaugucaugguuuucucaaauucucauagguacacuauuaauguggcuaggccuaaauacaaaaaacggaagcauaaguuuaauguguuuagcuuuaggagguguuuuaauuuuuuuaaguacagcgguaucagcagauguaggauguucaguugauuuuucaaaaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9196 - RNA, 2365 nt, Artificial Sequence
  KU720415.1 prME-long mRNA Design 3 opt
gggagaaagcuuaccaugagaauaauaaaugcaagaaaagagcgaaaacguagaggagcagauacaagcauuggaaucauagguuuacuauugacaacagcaauggcugcugaaauaacuagaagaggcuccgccuauuauauguaccuagacaggucagacgcagguaaagccauaagcuuugcaacaacauuaggcguaaauaaaugucauguacaaauaauggauuuaggacauaugugugacgcuacaaugaguuaugaauguccaauguuagaugaaggaguggaaccagacgauguugauuguugguguaauaccacuaguacauggguaguauaugguacgugucaccacaaaaaaggcgaagcaagaagauccagaagagcggucacauuaccaucacauucaacuagaaaacuacaaacaagaucccaaacauggcuugaaagcagagaguacacuaaacaccuaauaaaaguagaaaauuggauauucagaaacccuggauuugcauugguagcaguagcaauagcaugguuauuaggaaguagcaccucacaaaaaguaauauaucuaguaaugauucuacuaauugcaccagcauauucaauaagaugcauagguguuuccaauagagauuuuguagaaggaaugucaggaggaacauggguagacgucguccuagaacacggugggugcguaacuguaauggcacaggauaaaccaacuguagauauagaauuaguaacaacaacuguaucuaauauggcagaaguaagaucauauuguuacgaagcaucaauaucugauauggcaagugauuccagaugcccaacacaaggagaagcauauuuagauaaacaaucagauacacaauauguuuguaaaagaacccuggucgaucgagguugggguaauggauguggucuuuuugguaaaggaagccuaguaacaugugcaaaauuuacauguagcaaaaaaaugacaggaaaaucuauacaaccagaaaaucuugaauauagaauaauguuaaguguucauggaagccaacauucaggcaugauagugaaugauacagguuaugaaacagaugaaaacagggcgaaaguagaaguaacaccaaacucaccacgagcagaagccacuuuaggaggauucggaucauuaggacuagacugugagccaagaacaggauuggauuuuagugaucuauacuauuuaacaaugaauaauaaacacugguuaguacacaaagaaugguuccaugacauaccauuaccuuggcacgccggagcagacacaggaacaccccacuggaauaauaaagaagcgcuaguagaauuuaaagaugcacacgccaaaagacaaacugucguaguauuaggaucacaagaaggugcaguacauacagcucucgcaggagcauuagaagcagaaauggacggagccaaagguaaacuuuuuucaggacauuuaaaauguagauuaaaaauggauaaauugcgacuaaaagguguaagcuauucacuauguacagcagcauuuacauucacaaaaguacccgcagaaacacuacauggaaccgugacaguagaaguucaauaugcaggaacagauggcccauguaaaauaccuguacaaauggcaguagauaugcaaacacuaacucccgucggcagauuaauuacagcaaauccaguaauaacugaaaguacagaaaauucaaaaaugaugcuagaauuagauccgccauucggagauucauacauaguuauuggcgugggagacaaaaaaauuacacaucacuggcauagaagcggaaguaccauaggaaaagcuuuugaagcaacaguucgaggagcaaaaagaauggcaguauuaggugacacugccugggauuucgguuccguaggaggaguuuucaauucauuaggcaaagguauucaccaaauauuuggugcggcauucaaaucauuauuuggagguaugucaugguuuagucaaauacuaauaggaacauuacuaguaugguuaggauuaaauacaaaaaacggguccauaucuuuaacauguuuagcucuagguggcguuaugauauuuuuaaguacugcaguaagugcagauguuggcugcucagucgauuuuucuaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9197 - RNA, 2347 nt, Artificial Sequence
  DQ859059.1 prME-long mRNA Design 3 opt
gggagaaagcuuaccaugagaauaauaaaugcaagaaaagaaagaaaaagaagaggggcugauacaaguauagguauaguaggacugcuauuaacaacggcaauggcugcagaaauaacaaggaggggaucagcauauuacauguaucuagauagaucugaugcgggaaaagcaauaucuuuugcgacaacuuuaggaguaaauaaaugccauguacagauaauggauuuaggacauaugugcgaugcgacuaugaguuaugaaugcccaauguuagacgaagggguugaaccagacgacgucgauuguugguguaauacaacgaguacuuggguaguauauggaacaugccaucacaagaaaggcgaagcaagaagaagcagacgagcgguaacauuaccaucacauucaacaagaaaacuacaaacaaggucacaaacauggcuagaaagcagagaauauacaaaacauuuaaucaaaguagaaaauuggaucuucagaaauccagguuuuacucuaguagccgucgcaauugcaugguuauuaggaaguaguacaucacaaaaaguaauauauuuaguaaugauacuauuaauagcgccagcauauaguaucagauguauaggaguaagcaauagagauuuuguagaaggaaugucaggagguacauggguagacgugguacuugaacauggagguuguguuacuguaauggcacaagauaagccgacuguagauauagaauuaguuacaacaacuguaaguaauauggcagaaguucgaaguuauuguuacgaagcaucgauaagugauauggcaucagacucaagauguccuacacaaggugaagcauaucuagacaaacaaucagauacacaauacguauguaaaagaacauuaguagaucguggguggggaaauggaugcggauuguuuggaaaaggaagccuaguaacaugcgcuaaauuuaccuguaguaaaaagaugacuggaaaaucaauucagccggaaaaccuagaauacagaauaaugcuaucaguacacggaagucagcauucagguaugaucguaaaugacgaaaauagagcuaaaguagaagugacgccuaacaguccaagagcagaagcuacgcuaggagguuuugggagucucggauuagauugugaaccuagaacaggauuggauuuuagcgauuuauacuacuuaacuaugaauaauaaacauuggcuuguacauaaggaaugguuucaugacauaccauuaccauggcaugcaggagcagauacagguacaccccauuggaauaauaaagaagcucuaguugaguucaaggaugcacaugcuaaaagacaaacagucguaguauuggggucacaagaaggugcaguacauacagcucuugcuggagcacuagaagcugaaauggauggagcuaaaggaagacuguuuaguggucauuuaaaaugucgauuaaaaauggacaaauuaagauugaaagggguaagcuacucuuuauguacugcagcauucacguucacuaaaguaccggcugaaacauuacauggaacaguaacaguagaaguacaauaugcggguacagauggaccauguaaaguaccagcucaaauggcgguagauaugcaaacacuaacaccaguugggagauugauaacagcgaacccaguaauaacggaaaguacagaaaauaguaaaaugauguuggaacuugacccaccauucggagauaguuauauaguuaucggaguaggagauaagaaaauuacacaucauuggcauagaaguggaaguacaauugggaaagcauuugaagccacuguuagaggggcaaaaaggauggcaguuuuaggagauacagcaugggacuuuggaagcguaggcgguguuuuuaauagucuagguaaagggauacaucaaauauuuggugcagcauucaaaaguuuauuuggagggaugucaugguucagucaaauucuaauugguacacuauuaguaugguuaggucuaaauacgaaaaauggaaguauuucauugacaugucuugcauuagguggaguaaugauuuuccuaaguacagcuguuagugcagaugugggauguaguguagauuuuucaaaaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9198 - RNA, 2365 nt, Artificial Sequence
  KX377335.1 prME-long mRNA Design 3 opt
gggagaaagcuuaccaugagaauaauaaacgcuagaaaagaaagaaaaagaagaggagcagauacauccauaggaauaauaggauuacuucucacaacagcgauggcagcagaaaucacaagacgcggaagugcauacuauauguaucuagauagauccgaugcaggaaaggcgauaucauuugcaacgacauuaggcguuaauaaaugucauguacaaauuauggauuugggccacaugugugaugcuaccaugaguuacgaauguccuaugcuagaugaaggaguagaaccugaugauguggauuguuggugcaacacaacaucaacaugggugguuuaugguacuugccacagaaagaaaggugaagcaagaagaagcagacgagcaguaacacuuccaucccauucaacacggaaacuacaaacaagaucacaaacaugguuagaaucuagagaauacacaaaacaucuuauaaaaguagaaaauuggauuuuuagaaacccaggauuugcauuaguagcuguugcuauagcauggcuucuagguucaucaacaucacaaaaaguaauuuauuuaguuaugauauuauuaauagcuccagcauauaguauuagauguauuggaguaucgaauagagauuuuguugaagguaugaguggaggcacauggguggacgucguauuagaacacgggggauguguaacaguaauggcacaagacaaaccaacaguugacauagagcuaguaacuacaacaguaaguaacauggcagaaguaagaagcuauuguuaugaagccaguaucagugacauggcaagugacaguagauguccuacacaaggagaggcuuauuuagauaaacaaagugauacacaguauguauguaaaagaacauuaguagauagagguuggggaaauggcuguggacucuuuggaaaaggaucgcuaguaacaugugcaaaauuuacauguucaaagaaaaugacuggaaaaucaauucaaccagaaaacuuggaauaccgaauaaugcuaagcgugcauggaucccaacauagcgggaugauaguaaacgauacaggauaugaaacugacgaaaacagagcaaaaguagaaguaacuccaaauaguccaagagcagaagcaaccuuaggaggauuugguucuuuaggacuagauugcgaacccagaacaggauuagacuuuagugaccuuuauuauuuaaccaugaauaacaaacauuggcuaguucauaaagaaugguuucaugauauaccauuaccauggcaugcaggcgcagauacuggcacuccacauuggaacaauaaagaagcgcuaguagaauuuaaagacgcucaugccaagagacaaacaguggucguacuuggaagccaagaaggcgcagugcauacagcucuagcaggagcacuagaagcagaaauggauggugcaaaaggaaaguuauuuaguggacauuuaaaauguagacuaaaaauggauaaauuaagauuaaaaggagucagcuacucgcucugcaccgcagcauuuacauuuacaaaaguaccagcagaaacauuacauggaacaguuacaguugaaguacaauaugcagguacagauggaccauguaaaauaccaguucaaauggcuguagacaugcaaacauuaacgccuguagggagacuaauaacagcaaauccagucauaacggaaucaacagaaaacaguaaaaugaugcuagaacucgacccuccauucggagacucauacauaguaauuggaguuggagacaagaaaauuacucaccauuggcacagaucagggucaacaauaggaaaagccuucgaagcaacuguaagaggagcuaaaagaauggcuguauuaggcgacacagcaugggauuuuggauccgucggaggaguauuuaauagcuuaggaaaaggaauacaccaaauauuuggagcggcuuuuaaaucacuuuuuggcggaaugucaugguuuucacaaauacuuauaggaacucuauuaguaugguuaggccuaaauacuaaaaauggaaguauaucauuaacaugucuagcauuaggaggagucaugauauucuuaagcacagcaguaagugccgacguaggaugcucaguagauuuuaguaaaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9199 - RNA, 2365 nt, Artificial Sequence
  LC002520.1 prME-long mRNA Design 3 opt
gggagaaagcuuaccaugagaauaauaaaugcaagaaaagaaagaaaaaggagaggugccgauacgucuauagguauaauaggauuauuacuaacuacagcaauggcggcagaaauaacacgaagaggaagugcguacuacauguaucuagacagaagugacgcaggaaaagcaauuagcuucgcaacaacacuugguguaaauaaaugucauguccaaauaauggauuuaggacauaugugugaugccacaaugucauaugaauguccaaugcuagaugaaggaguggagcccgaugacguugacuguugguguaauacaacaagcacuuggguaguauaugguacuugccaucauaagaaaggugaagccagaagaagcagacgagcaguuacauuaccaucacacagcacuagaaaauuacaaacaaggagucagacuugguuagaaagucgagaauacacaaaacaccuaauuaaaguagaaaauuggauauuuagaaacccuggcuucgcauuaguagcaguugcaauagcauggcuacuagguaguaguacaagucagaaaguaauuuauuuagucaugauccuauugauagcaccagcauauucaauaagauguauugggguuucaaauagagauuucguagaggggaugaguggcggaacauggguagacguaguauuagaacauggaggcuguguuacgguaauggcgcaagauaaaccaacugucgauauagagcuaguaacaacaacaguaucaaauauggcagagguaagaucuuacuguuaugaggcaaguauaagugauauggcaucagacaguagauguccuacacaaggagaagcauauuuagauaaacaaucggauacacaauauguauguaaaaggacgcuaguagaucgaggauggggaaacggauguggauuauucggaaaaggaaguuuaguuacaugcgcaaaauucacauguucaaagaagaugacaggaaaaucaauacaaccagaaaaccuagaauacagaauaauguuaucuguacacggaagucagcauucaggaaugacaguaaaugacauaggauacgagacugaugaaaauagagcuaaaguagaaguaacuccaaauucaccgagagcagaagcuacauuaggaggauuuggaagucuaggacuagacugugaaccucgaacagguuuagauuuuagugauuuauauuacuuaacaaugaacaacaaacacuggcuaguucauaaagaaugguuucaugacauaccauuacccuggcacgcuggugccgauacaggaaccccacauuggaacaauaaagaagcauuaguagaauuuaaagaugcacaugcaaaaagacaaacaguaguagucuuggguucacaagaaggcgccguacauacggcauuagcaggggcuuuagaagcagagauggauggcgcaaaagguaaauuauuuucgggacaccuaaaaugcagauuaaaaauggauaaauuacgauuaaaaggaguaucauauucacuauguacagcagcauuuacauuuacaaaaguaccagcugaaacucugcacggaacagugacgguagaaguucaauacgccgguacagauggaccaugcaaaauaccuguacaaauggcuguagauaugcaaaccuuaacaccaguaggaagauuaauuacugcaaauccaguaauuacagagagcaccgagaauagcaaaaugaugcuagaauuagauccaccuuuuggugauucauauauaguaaucgguguuggagauaagaaaauaacacaccacuggcauagaucaggaucaacaauagguaaagcauucgaagcaacaguaagaggcgcaaaacgaauggcuguacuaggugauacagcuugggauuuuggaucaguaggaggaguauuuaacagucuaggaaaaggaauacaucagauuuuuggggcagcauucaaaaguuuauuuggaggcaugagcugguucagucaaauauuaauuggaacacuuuuaguauggcuaggauuaaauacgaaaaaugguaguauaagucugacaugucuagcauuaggugguguaaugauauuucuuagcacagcggucagcgcagauguaggauguucuguggacuuuaguaaaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9200 - RNA, 2353 nt, Artificial Sequence
  KU963573.2 prME-long mRNA Design 3 opt
gggagaaagcuuaccaugcgcauaauaaaugccagaaaagaaagaaaaaggagaggugcagauacauccauaggaauaauaggacuguugcuaacgaccgcaauggcagcagaaauuacaaggaggggcucagcauauuauauguaucuagauaggucugaugcaggaaaagcaauaaguuuugcaacaacacuagggguaaauaaaugccauguucaaauaauggauuuaggacauaugugugaugcaacaaugaguuacgaaugcccuaugcuagacgaaggaguggaaccggacgacgucgauugcugguguaauacaacuucaacauggguuguauaugguacuugccaucauaaaaaaggagaagcaagaagaagccgaagagcaguaacacuaccaagccauagcacucgaaaauugcaaacaagaucucagacauggcuagaaucaagagaauauacaaaacauuuaaucaaaguagaaaauuggauauuuagaaauccaggauucgcccuaguagcaguggcaauagcaugguuauuaggaucuucaacaagucaaaaagucauauauuuagugaugauuuugcuaauagcuccagcauauucuauaagauguauaggaguaucaaacagagacuuuguugaaggaaugaguggcggaacauggguagauguaguauuagaacauggaggaugugugacaguaauggcucaagauaaaccaacuguugauauugaacuuguaacaacaacaguaucuaacauggcugaaguaagaaguuauuguuaugaggcuucuauaucagauauggccucagauaguaggugcccuacacaaggagaagcauacuuagauaaacaaagugacacacaauacguauguaaacgaacuuuaguagauagagguuggggaaauggcuguggucuauuuggaaaaggaagucuaguaacaugugcaaaauuuacauguucaaaaaaaaugacuggaaaaucaauucaaccagaaaauuuagaguauagaauaaugcuaucaguacauggaagucaacacagugggaugauaggauacgaaacagacgaaaauagggccaaaguagaaguaacaccgaacucuccaagagcggaagcgacauuagggggauucggaucauuaggauuagauugugaaccaagaacaggauuagauuuuagcgaucuauauuacuuaacaaugaauaacaaacauuggcuaguacauaaagaaugguuucaugauauaccucuaccauggcaugcaggagcagauacugguacgccacauuggaacaauaaagaagcauugguagaauuuaaagaugcacaugcuaagaggcaaacgguuguaguacucggaucacaagaaggagcaguacauacugccuuagcuggugcacuagaagcagaaauggauggugcaaaaggaaaacuauuuaguggacauuuaaaaugucgacuaaaaauggacaaacuaagacuaaaaggaguuucauauucuuuaugcacagccgcauuuacauucacaaaagucccagcagaaacacuucacggaacagugacaguugaaguacaauaugcaggaacggauggaccguguaaaauaccuguacaaauggcaguagauaugcaaacacuaacaccaguaggaagauugauaacagcaaacccaguaauaacagaaucaacagaaaacucaaaaaugauguuagaguuggauccgccauucggagauaguuauauuguuauaggaguaggcgacaagaaaauaacucaucauuggcauagaucaggaagcacuauagguaaagcguucgaggcaacggugagaggggcuaaaagaauggcaguauuaggagauacagcaugggauuuuggaaguguaggaggaguauucaacucacuaggaaaaggaauacaucaaauauuuggagcagcuuuuaaaucacuauucgguggcaugagcugguuuucacaaauauuaauaggcacacuauuaguaugguuaggacuaaacacaaaaaauggaaguauaagucuaacauguuuagcacuaggaggaguaaugauauuucuaucaacagcagugagugcugauguagguugcaguguugauuucucgaaaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9201 - RNA, 2365 nt, Artificial Sequence
  KX694534.2 prME-long mRNA Design 3 opt
gggagaaagcuuaccaugagaauaauaaaugcaagaaaagaaaagaaaagacguggagcugauacaucaguaggaauaguaggauuacuauuaacaacugcgauggccgcagagguaacacgaagaggaucagccuacuauauguaucuggacagaaaugaugcaggagaagcaauaaguuuuccaacuacauuagguaugaauaaauguuauauacaaauuauggacuuaggacauaugugcgaugcuacaaugucauacgaaugcccaauguuagaugaagguguagaacccgacgauguugauuguugguguaacacaacaaguacauggguaguuuacgggaccugucaccauaagaaaggagaagcgagaagaucaaggagagcagucacucugccaagccacucuacaagaaaauugcaaacaagaagucaaacauggcuagaaaguagggaauacacaaaacauuuaaucagaguagaaaacuggauauuuaggaauccaggcuuugcacuagcagcagcagcaaucgcuugguugcuagguagcaguacaagucagaaaguaauauauuuaguaaugauuuuauuaauagcaccagccuauucaauucgauguauaggugucagcaauagagauuuuguagaaggaaugucuggcggaacauggguugauguaguacuugaacauggaggaugugugacaguaauggcucaagacaaaccaacuguagacauagaauuaguaaccacuacuguaaguaauauggcagaaguaagaaguuauuguuaugaggcuucaauaucagauauggcaucagacucaagauguccaacacaaggagaagcauaucuugacaaacaaucagauacgcaauauguauguaaaagaacucuagucgauagaggaugggguaacggauguggauuauucggaaaagguagcuugguaacuugugcaaaauuugcauguaguaagaaaaugacagggaaaaguauacaacccgaaaaucuagaauaucgaauaauguuaagugugcauggaucgcaacauaguggaaugauaguaaaugauacaggacaugaaacagaugaaaauagagcuaaaguagaaauaacaccaaauucaccgagagcagaagcaaccuuaggaggguuuggaaguuugggauuagauugugaacccagaacaggcuuagacuuuucagaucuauauuaccuaacuaugaacaauaaacauugguuaguacauaaagaaugguuucaugauauaccuuuaccauggcaugcaggagcagauacugguacaccgcauuggaauaauaaagaagcauuagucgaauuuaaggaugcacacgcaaaaagacaaacaguaguaguacuaggaucucaggaaggcgcagugcauacagcacucgcuggugcauuagaagcagaaauggauggagcaaaaggaagauuaagcucgggacaucuaaaauguagauuaaaaauggacaaauugagauuaaaagguguaagcuacaguuuaugcacagccgccuucacauucacaaaaauaccugcagaaacauuacauggaaccguuacgguagaaguacaauacgcaggaacagauggaccauguaaagucccagcacaaauggcaguagauaugcaaacauuaacaccaguagguagauugauaacugcaaauccaguaauuacggaaucgacagaaaauaguaaaaugaugcuagaauuagauccaccauucggcgauaguuauauaguaauaggaguuggagagaaaaagauaacacaucacuggcaucgaagugguucaacaauaggcaaagcauucgaagcaacagucagaggagcaaaaagaauggcuguauuaggcgacacagcgugggacuucggaaguguagguggagcacuaaauucauuaggaagaggaauacaucaaauauuuggagcagcauuuaaaucacuauuuggagguaugagcugguuuagucaaauauuaauuggaacauuauuaaugugguuaggacuaaauacuaaaaaugguucuauaaguuuaauguguuuagcacuaggaggaguacuaauuuuucucaguacagcuguaucagcagauguugguuguucaguugauuucagcaaaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9202 - RNA, 2365 nt, Artificial Sequence
  KX447520.1 prME-long mRNA Design 3 opt
gggagaaagcuuaccaugagaauaauaaacgcacgaaaagagaaaaagagaagaggcgcagaugccagcguaggaauaguaggauuacuacuaacaacugcaauggcagccgaagucacucgaagaggaagugcauauuauauguauuuagauaggaaugaugcaggggaagcaauaucauuccccacaacauuaggaaugaauaaaugcuacauacaaauaauggauuuaggacauaugugugacgcaacgaugucauacgaauguccuauguuagacgagggaguugaaccagaugacguagauugcuggugcaauacaacaucaacauggguuguauauggcacuugucaccauaagaaaggagaagcgagaagaucuaggagagcaguaacacuaccaucacauaguacgagaaaacuacaaacaagaucucaaacaugguuagaaucaagagaauauacaaaacacuuaauaagaguagaaaacuggauauucagaaacccaggauucgcauuagcagcagcagcaauugcgugguuacuaggaaguaguacaagccaaaaaguuauauaucuugucaugauucuauuaauagcaccagcauauaguauuaggugcauaggcguuagcaacagagauuucguagaagggaugucaggaggaacauggguagauguuguauuagagcaugggggaugugucaccguaauggcacaggauaaaccuacaguagacaucgaauuaguuacaacaacaguaucaaauauggcagaaguaagaucuuauugcuaugaagcaucaauaucagacauggcuagugauagccgaugcccuacacaaggagaagcauacuuagauaaacaaucagauacacaauauguauguaaaagaacccuaguagauagaggauggggaaauggauguggauuauucggaaaaggaucauugguaacuugugcaaaauuugcauguucaaagaaaaugacuggaaaaagcauacagccugaaaaucuugaauacagaauaaugcuuaguguacacggaucucaacauucagggaugauaguaaacgauacagggcaugaaacagaugaaaauagagcgaaaguagaaauuacaccuaauagucccagagcugaagcaacacuaggaggauucggaagccuaggacuugauugugaaccccguacaggauuagauuuuucagacuuauauuauuugacaaugaacaauaaacauuggcuaguccacaaagaaugguuccacgacauaccgcuacccuggcacgcaggagcggacacugguaccccacauuggaauaauaaagaagcauuaguagaguucaaagaugcacaugcuaaacgacaaacaguaguaguacuuggaagucaagaaggagcaguacauacagcauuagcgggugcacuagaagcagaaauggauggagcaaaaggaagauuaaguagugggcaucuaaaaugcagacucaaaauggauaaacuaagguuaaaaggaguaucauauucauuauguacagcagcuuuuacauuuacuaaaauaccugcagaaacguuacauggaacgguaacugucgaaguacaauaugcuggaaccgacggaccaugcaaaguaccugcacaaauggcaguagauaugcaaacauuaacuccuguaggcagauugauaacugcaaacccugucauaacggaaucaacagaaaauaguaaaaugaugcuugaauuagacccaccauuuggagauaguuauauaguaaucggaguaggggaaaagaaaauaacacaucacuggcacaggucggggucaacaauaggaaaagcguuugaagcaacaguaagaggagcaaaaaggauggcaguauuaggugacacagcuugggauuuuggaagcguagguggugcauuaaauaguuuaggaaaaggcauucaucaaaucuucggagcggcauuuaaaagucuauucggaggaaugucuugguuuucucaaauacuuauuggaacuuuauuaauguggcuaggauuaaauacuaaaaacgguaguauaaguuuaaugugccucgcauugggaggaguauuaauauuucucaguacagcgguaagcgcagacguaggguguagcguagauuucucuaaaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9203 - RNA, 2365 nt, Artificial Sequence
  KX369547.1 prME-long mRNA Design 3 opt
gggagaaagcuuaccaugagaaucauaaaugcucggaaggaaaaaaaaagaagaggagccgauacaagcguaggaauaguaggauuacuucuaacgacagcgauggcggcagaggucacaaggagaggauccgcauauuacauguacuuggauagaaaugaugcaggagaagcaauaucauuuccaacaacacuaggaaugaacaaauguuauauacaaauaauggaucuaggacauaugugcgaugcuacaaugucauaugagugcccaauguuggaugaaggaguagagccagaugauguagacuguugguguaacacaacaucaacuuggguuguauacgggacgugucaucauaaaaaaggggaggcgaggaggucgagaagagcaguaacguuaccaucacauagcacaagaaaauuacaaacacgaagucaaaccuggcuagaaaguagagaauauacaaaacauuuaauuagaguagaaaauuggauauuuagaaacccaggauuagcguuagcugcagcagcaauagcauggcuuuuagguagcucgacaagucaaaaaguuauauaucucguuaugauacucuuaauagcaccugcauauaguauaagauguauuggaguaaguaaucgagacuuuguagaagguaugucaggaggaacaugggucgaugugguacuggaacauggaggauguguaacuguuauggcacaagauaaaccaacaguagacauagaguuaguaacaacaaccguaucaaacauggcagaagugcguaguuauugcuaugaagcgucgauaucagacauggcaagugauagccgauguccaacucaaggagaggcauauuuagauaaacaaagugauacucaauauguaugcaaaagaacacuagucgauagagguugggguaacggaugcggauuauucgggaaaggcucauuaguaacuugugcuaaauuugcuuguucaaaaaaaaugacuggaaaaagcauucaaccagagaauuuggaauaucguauaauguuaaguguucauggaucacaacacucagguaugauagucaaugauacaggacaugaaacagacgaaaauagggcaaaaguagaaauaacaccaaauaguccuagagcagaagcaacauuaggcggauuugggaguuuaggcuuagacugugagccaagaacuggauuagacuuuagcgacuuauauuacuuaacaaugaacaacaaacauugguuaguacacaaagagugguuucaugauauaccguuaccauggcaugcaggagcagacacuggaacaccacauuggaauaauaaagaggcauugguagaauuuaaagaugcccaugcgaaacgacaaacagugguaguacuaggaucacaagaaggcgcaguacauacagcacuugcuggcgccuuggaagcagaaauggacggggcuaaagguagauuaaguucaggucauuuaaaauguagauuaaaaauggacaaauuaagauuaaaaggugugucauauucauugugcacagcagcauucacauuuacuaaaauaccagcugaaacauuacacgguacaguaacaguagaaguucaauaugcagguacggacggcccauguaaagucccagcucaaauggcgguagauaugcagacauuaacuccaguugguagacuaauaacagcaaauccuguaaucaccgaaaguacugaaaauucaaaaaugauguuggaacuugauccaccauuuggagauucauauauuguaauagguguaggggaaaaaaaaauaacacaucauuggcacagaaguggaaguacgauuggaaaagccuuugaagcaacgguaaggggugcaaaacgaauggcaguauuaggugauacagcaugggauuuuggcaguguaggaggugcacuaaauucauuaggaaaaggaauacaucaaauauucggagcagcauuuaaaagcuuguuuggugguaugucaugguuuucacaaauacuaauaggaacacuauuaaugugguuaggauuaaauacaaaaaaugggaguauaagucucaugugucuggcauuaggcggaguacucauauuuuuaaguacagcaguuagcgcagauguaggauguaguguagauuuuaguaaaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9204 - RNA, 2365 nt, Artificial Sequence
  KX447515.1 prME-long mRNA Design 3 opt
gggagaaagcuuaccaugcgaauaauaaaugcacgaaaagaaaagaaaaggagaggagcugacacuuccguaggcauuguaggauuacucuuaacaacugcuauggcagcugaagucaccagaagagggucagcauauuacauguaucuugauagaaaugacgcaggggaagcaauuagcuuuccaacaacacuuggaaugaauaaauguuacauacaaauaauggaccucggacauaugugcgacgcaacuaugagcuaugaauguccaaugcuagacgaaggaguagaaccagaugacguagacuguuggugcaauacuacaaguacuuggguaguuuaugggacaugccaucauaagaaaggugaagcaagaagaucuaggagagcaguuacauuaccuagucauagcacgagaaaacuacaaacaagaucccaaacaugguuagaaucaagggaauacacaaaacaucuuauaagaguagaaaauuggauauucagaaaucccgguuucgcucuagcagcagcugcuauagcuuggcuauugggaaguagcacuagccaaaaaguaauauacuuaguaaugauacuauuaauagcuccugcauauucuauaagauguauuggaguaaguaacagagacuucguugaaggaaugaguggaggcacauggguagaugucguacuugaacacggaggauguguaacaguaauggcacaagauaaaccgacaguagauauugaauugguaacaacaacagucaguaauauggcagaaguuagaaguuauuguuaugaagcuaguauaagugacauggcaucagauucacgauguccuacacaaggagaggcuuaucuagacaaacagucugauacacaauacguguguaaaagaacuuuaguugaucgaggauggggaaauggauguggacuauuuggaaaaggaucauuaguaacaugugcaaaauucgcauguucaaagaaaaugacaggaaaaagcauacaaccagaaaauuuagaauacagaauaauguuaagugugcauggaucccaacacagcggcaugauaguaaaugauacaggacacgaaacagaugaaaacagagcaaaaguugaaauuacaccaaauaguccacgagcggaagccacacuuggaggguucggaucacuaggacuugacugugaaccaagaacuggauuagauuucucagauuuauauuacuuaacaaugaauaacaaacauugguugguacauaaagaaugguuucacgauauuccgcuaccauggcaugcuggagcagauacagggacaccacauuggaauaacaaagaagcucuaguagaauuuaaagaugcacaugcaaagagacaaacaguaguaguacuaggaagucaggaaggagcaguacauacagcacuagcaggagcucuagaagcugaaauggauggugcaaaaggaagacuaaguagcggacaucuaaaauguagacuaaaaauggacaaacuaagacuaaaggggguuucauauucauuauguacagcagcuuuuacauucacaaaaauaccugcagaaacuuuacaugguacaguaacaguugaaguacaauaugcuggaacagacggacccuguaaaguaccagcacaaauggcaguagauaugcaaacauuaacaccaguuggacgauuaauaacagcaaaucccguuauaaccgaaaguacagaaaauucuaaaaugauguuagaauuagaucccccauucggagacagcuauauagugauuggaguaggagaaaagaaaauuacacaucacugguaccgcucaggaucaacaauaggaaaagccuucgaagcuacuguaagaggugcaaaacgaauggcaguacuaggggacacagcgugggauuucgguucaguaggaggagcacuuaacuccuuagguaaaggcauacaucaaauauuuggagcagcuuuuaaaucucuauuugggggcaugucaugguucucacaaauuuuaaucggcacacuacuaaugugguuaggacuaaauacuaaaaacggaucaauaagucucaugugucuagcccuaggaggaguacuaauauuucuaaguacugcuguaucagccgaugugggaugcaguguagauuucagcaaaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9205 - RNA, 2365 nt, Artificial Sequence
  KU501217.1 prME-long mRNA Design 3 opt
gggagaaagcuuaccaugagaauaauuaaugcacgaaaagaaaaaaaaagaagaggagcugauacaaguguaggcauaguagguuuacuguuaacuaccgcuauggcagcagaaguaacgagaagaggaucagcauauuauauguauuuagauagaaaugaugcuggggaagcaauaucauuuccuacaacauuaggaaugaauaaaugcuauauucaaauaauggaucugggacacaugugugaugcaacaaugucauaugaaugccccauguuagaugaagguguagaaccagaugauguagacuguugguguaauacaacaucaacuuggguaguauauggaacaugccaucauaaaaaaggagaagcgagaagaagcagaagagcuguaacauuaccaucacauaguacuagaaaacuacaaacaagaagccaaacauggcuugaaaguagggaauauacuaaacaucuuauaagaguagaaaauuggauauuuagaaauccaggauucgcauuagcagcugcagcuauagcauggcuauuaggaucauccacaagucaaaaaguaauauauuugguaaugauauuacuaauugcaccagcauacucaauaagauguauaggagucaguaauagagauuuuguggaaggaaugagcggaggaacauggguagacguaguuuuagaacacgguggaugcguuacaguuauggcacaagauaaaccaacuguagacauagaauuaguuacaaccacaguaaguaauauggcagagauuagaucauauuguuaugaagcauccauaagcgauauggcaucggauaguagauguccaacacagggcgaagcauaccuagauaaacaaagcgauacgcaauauguuuguaaaagaacgcuaguagauagaggaugggguaaugguuguggacuuuucggaaaaggaagccugguaaccugugcaaaauucgcauguucuaaaaaaaugacaggaaaaucuauucaaccagaaaaucuggaauauagaauaauguuaagcguccauggaagucaacauuccggaaugauuguaaaugauacgggacaugaaacagacgaaaacagagcaaaaguugaaauaacaccaaauuccccaagagcagaagcaacccuaggaggauuuggaucauuaggauuagauugcgaaccuagaacaggacuagacuucucagaccuguauuaccuaacaaugaacaauaaacauugguuaguacauaaagaaugguuccaugauauaccacuaccguggcaugcaggagcugacacuggaacaccccauuggaauaacaaagaagccuuaguagaguuuaaagaugcacacgcaaaacgacaaacaguagucguccuagguagucaagaaggugcuguacauacagcauuagcuggugcucuagaagcagaaauggauggagcuaaaggaagacuaucaaguggacaccuaaaaugccgauuaaaaauggauaaauuaagacuaaaaggaguaaguuacaguuuaugcacagcggcauuuacauuuacaaaaauacccgcagaaaccuuacaugguacaguaaccguagaaguacaauaugcaggcacggauggaccauguaaaguaccagcacaaauggcuguugauaugcaaacacuaacaccgguaggccgauuaauaacugcuaacccaguaaucacagaaaguacugaaaauaguaagaugauguuagaauuggacccaccauuuggagacucauauauaguaaucggcguaggagaaaaaaaaauuacacaucacuggcauagaucaggaaguacaauaggaaaagccuucgaagcaacuguaagaggagcaaagagaauggcaguacuaggagauacagcaugggauuuuggaucgguuggaggagcucucaauagcuugggaaaaggcauacaucaaauauuuggagcagccuuuaaaaguuuguucggaggaaugaguugguuuucucaaauauuaaucgggacacuacuaauguggcugggauuaaauacaaaaaauggcucaauaagucucaugugcuuagcuuuagggggcguuuuaauauuuuuaaguacagcaguaucagcagacguugguugcagcguagauuuuagcaaaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9206 - RNA, 2365 nt, Artificial Sequence
  KU312314.1 prME-long mRNA Design 3 opt
gggagaaagcuuaccaugagaauaauaaaugcccgaaaagaaaaaaaacgaagaggagccgacacaaguguaggaaucguaggguuauuacuuacgacggcuauggcggcagaaguaacacgaagaggaagugccuacuacauguacuuggacagaaaugacgcaggagaagcaauaucauuuccaacaacacuagguaugaacaaauguuauauucaaaucauggaucuaggucauaugugugaugccacuaugagcuacgaaugcccaaugcuugaugagggcguagaaccugaugauguggacuguuggugcaacacaacuaguacuugggucguguacggcacaugucaucauaaaaaaggagaagcaagaagaagcaggagagcaguaacguuaccgagccauucaacaagaaaacuacaaacaagaagccaaacaugguuagagagucgagaauauacaaaacacuugauaagaguagaaaacuggauauuuagaaauccagguuucgcauuagcagcagcagcaauugcauggcuauuggguaguuccacaagucaaaaaguaauuuauuuaguuaugauauuauuaauagcucccgcauacucaauaagaugcauaggaguaagcaauagagauuuuguagagggaauguccggaggaacguggguagauguagucuuagaacaugguggauguguaacuguaauggcacaagauaaaccaacuguagauaucgaacuuguaaccacaaccguaucaaauauggcagaaguuagaucguacugcuaugaggccucaauaucagauauggcaucagauucaagauguccaacacaaggugaagcauaucuugacaaacaaucugauacucaauauguauguaaaaggacacuaguagauagagguugggguaauggcuguggacuauuugguaaaggaucucuaguaacaugugcaaaauuugcauguucaaaaaaaaugacaggaaaaaguauacaaccagaaaaucuagaauacagaauaauguuauccguacaugggagccaacauagcggaaugauaguaaaugauacuggacacgaaacagaugaaaaucgagcaaaaguagaaauaacucccaauucaccuagagcugaagcaacccuaggagguuuuggaaguuuaggauuagauugugaaccacgaacaggucuagauuuuucagaucuauauuauuuaacaaugaauaacaaacacugguuaguacauaaagaaugguuucaugauauaccauuaccauggcacgcaggggcagacacaggaacuccccacuggaacaacaaagaagcuuuaguggaauuuaaagaugcacaugcaaaaagacaaacaguaguaguacuaggcucucaagaaggagcugugcauacugcauuagcaggagccuuagaagcagaaauggauggagcaaaagggagauugucaucagggcauuuaaaaugucgacuaaaaauggauaaauuaagauuaaaaggggucagcuauucacuauguacggcagcuuuuacauuuacaaaaauaccagcagaaacacuccaugguacaguaacaguagaaguucaauaugcagguacagauggaccauguaagguucuagcacaaauggcaguagauaugcaaacguuaacuccuguaggaagauuaauaacagccaauccuguaauaacagaaucaaccgaaaauucaaaaaugauguuagaauuagauccuccuuuuggagauucuuauauaguaauagguguuggugaaaaaaaaauaacacaucauuggcauagaaguggaagcacaauagguaaagcauuugaagcaacaguaagaggagcaaaacgaauggcuguacuaggagacacagcuugggauuucggaaguguaggcggagcauuaaauucauuaggaaaggguauacaucaaaucuuuggggcugcauucaaaaguuuauuugguggaaugagcugguucucacaaauucuuaucggaacacuauuaauguggcuaggucuuaauacaaaaaaugggucaauaucuuuaauguguuuagcauuagggggaguacuuauauuccucucaacagccguaucagcagacguuggauguucaguagauuuuucaaaaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9207 - RNA, 2365 nt, Artificial Sequence
  KX446950.2 prME-long mRNA Design 3 opt
gggagaaagcuuaccaugagaauaauaaaugccagaaaagaaaaaaaaagacguggugcugacaccaguguaggaauaguaggauuauuguuaacaacugcaauggcggcagaaguaacaagaaggggaagugcauauuauauguaucuagauagaaacgacgcaggcgaagcaauaaguuucccaacaacauuaggaaugaacaaauguuauauacaaauaauggaccucgggcacaugugcgaugcaacaaugaguuaugaaugcccaacacuagacgaaggaguugaaccggaugacguagauuguuggugcaacacaacaaguacguggguuguauaugguacgugucaucauaaaaaaggugaagccaggaggucaagaagggcaguaacauugccaucccauaguacacggaaauugcaaacaagaucacagacuuggcuugaaagcagagaauauacaaaacauuuaauaagaguagaaaauuggauauuucggaauccaggauuugcauuagcagcugcugcaauugcauggcuucuagguucgucaacaucacaaaaaguaauauauuugguaaugauauuguuaauugcuccagcauauucaauucguuguauagguguaagcaaucgugauuucguagaaggaaugagcggagggacguggguugaugucguguuagaacauggaggguguguaacaguaauggcacaagauaaaccaacaguagauauagaauuaguaacaacuacaguaagcaacauggcagaaguaagaucauauuguuaugaagcaaguauauccgacauggccuccgauaguagaugucccacacaaggugaagcguauuuagauaagcaaucugauacacaauacguaugcaaaagaacacuaguagauagagguuggggaaauggcugcggauuauuuggaaaaggcagucuaguuacaugcgcaaaauuugcauguagcaaaaaaaugacaggaaaaaguauucaaccagaaaacuuagaguauaggauaauguuaucgguacacggaagucaacacucaggaaugauuguaaacgacacgggccacgaaacugacgaaaauagagcaaaaguagaaaucacgccaaauucaccacgagccgaagccacauuaggaggauuuggaucacugggauuagauugcgaaccuagaacgggauuggauuuuagugauuuauauuauuuaacuaugaauaauaaacauugguuaguacauaaagagugguuucaugauauaccucuaccuuggcaugccggggcagauacuggaacuccacauuggaauaauaaagaagcauuaguagaauuuaaagaugcccacgcaaaaagacaaacaguaguuguauuaggaagucaggaaggagcuguacauacagccuuagcaggagcacuagaagcagaaauggauggagcaaaaggaagauuaucaaguggacacuuaaaauguagauuaaaaauggacaaacuaagacuuaaaggugugucauacuccuuauguacagccgcuuuuacuuuuacuaaaauuccagcggagacuuuacaugggacuguaacaguagaaguucaguaugcagguacagaugguccaugcaaaguaccagcccaaauggcaguugauaugcaaacauuaacaccaguaggaagauuaaucacagccaaucccguaaucacagaauccacagaaaauaguaagaugaugcuagaauuagacccaccguuuggagauaguuauauaguaauaggaguuggggaaaagaaaauaacacaucauuggcaccgaagcgguagcaccauaggaaaagcuuuugaagcaacaguuagaggagcuaaaagaauggcaguauugggugauacagcaugggauuucggaucaguagguggagcauuaaacagcuuggguaaaggaauacaucaaauuuucggagcagcauuuaaaagcuuauuuggaggaaugaguugguucucacaaauauuaauaggaacacuauuaaugugguuaggacuaaauacaaaaaauggaaguauaaguuuaauguguuuagcauuagggggaguacuaauauucuuaucaacagcaguaucugcugacguaggaugcucaguagauuuuagcaaaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9208 - RNA, 2365 nt, Artificial Sequence
  KY003157.1 prME-long mRNA Design 3 opt
gggagaaagcuuaccaugaggauaauaaaugccagaaaagaaaagaaaaggagaggagcagacacaagcguaggaauaguaggcuuauuauuaacaacagcaauggccgcagagguaacucgaagaggaucagcguacuauauguauuuagauagaaaugaugcaggagaagcaauaucauuuccaacaacauuaggaaugaacaaaugcuacauacaaauaauggauuuagggcauaugugugaugccacuaugaguuaugaaugcccaaugcuagacgaggguguggaaccagaugacguagauuguugguguaacacaacaucuacauggguuguauauggaacuugucaucacaagaaaggagaagcacgaagaagcaggagggcaguaacacuaccaagccauucaacuagaaaacuccaaacaagaagucaaaccugguuagaaucaagagaauauacgaaacaucuaauaagaguagaaaacuggauauuuagaaaucccggauuugcauuagcagcagcagcaaucgccuggcuauuaggaaguucaacaagucaaaaagugauauaucuagucaugauacuacuaauugcaccagcuuauagcauaagauguaucggugucagcaauagagacuucguugaagguaugucagguggaacguggguagacguuguuuuagaacacggcggauguguaacaguaauggcacaagauaaaccaacgguagacauagaacuugugacaacuacuguuaguaacauggcagaaguacgaagcuauugcuaugaagcaucuauaucagauauggcaucagauucacgauguccuacacaaggagaagcauacuuagauaaacaaagcgauacacaauauguuuguaaaaggacauuaguagauagaggcuggggaaaugguuguggauuauuuggaaaagguucauugguaacgugugcaaaauucgcuuguagcaagaaaaugacagguaaaucaauacaaccugaaaacuuggaauacagaauuaugcuaucaguacauggaucacaacauuccggaaugauaguaaaugauacuggucaugaaacagaugaaaaccgagccaaaguagaaauaacaccuaauucuccaagagcagaagcuacauuaggaggauucggaucacuuggucuagauugcgaaccaagaacuggacuugacuuuagugauuuauacuauuuaacaaugaauaauaaacauuggcuaguacauaaagaaugguuucaugacauaccauuaccauggcacgcaggagcagauaccggaacaccacacuggaacaauaaagaagcucuaguagaguucaaagaugcucaugcaaaaagacagaccgugguaguauuaggaucacaagaaggagcuguacauacggcucuagcaggagcacuugaagcggaaauggauggugcaaaaggacgauuaaguucagggcaucuaaaauguagauuaaaaauggacaaauuaagauuaaaaggaguaaguuauaguuuaugcacagccgcuuuuacauuuacuaaaauaccagcagaaacguuacauggaaccguuaccguagaaguacaauaugcaggaacagaugguccaugcaagguaccagcacaaauggcaguagauaugcaaacgcuaacaccaguaggaagguuaaucaccgcuaauccagugauaacagaaucgaccgaaaauuccaaaaugauguuagaauuggauccaccuuuuggagacuccuauauaguaauagggguuggggaaaagaaaauaacccaccauuggcauagaucagggucaacaauaggaaaggcuuucgaggcaaccgugcgaggagcaaaaagaauggcgguuuuaggggauacugcaugggauuuuggaagugugggaggagcauuaaacagccuggguaaagguauacaucaaauauucggagcagcauucaaaucauuauuuggaggaaugagcugguuuagucagauacuaauuggaacauuacugauguggcuuggauuaaacaccaaaaacggaucaauuagcuuaaugugcuuagcacuugguggaguauuaauauuccuaaguacaguaguuucagcagauguagguugcucaguagacuucagcaaaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9209 - RNA, 2365 nt, Artificial Sequence
  KX811222.1 prME-long mRNA Design 3 opt
gggagaaagcuuaccaugagaauuauaaaugccagaaaagaaaaaaaaagaagaggcgccgauacaucaguagggauaguaggauugcuauuaacaacagccauggcagcagaaguuacaagacgaggaucagcauauuacauguacuuagauagaaaugaugcaggagaagcuauaaguuucccgacuacuuuaggaaugaacaaguguuauauucaaauuauggacuuaggacacaugugugacgcaacaaugucauaugaaugcccaauguuagacgaaggaguagaaccagaugauguagauuguugguguaacacuacaagcgcuugggucgucuacgggacaugccaccacaaaaaaggagaagcuagacgaaguagaagagcaguaacccuaccaucucauaguacacgaaaacuacaaacuagaccucaaaccugguuagaaucaagagaauacacaaaacauuuaauacgaguagaaaauuggauauucagaaacccaggauucgcguuggcagcggcggcaauugcaugguuauuaggaucaaguacaucucaaaaagucauauauuugguuaugauacuuuuaauagcuccagcauauagcauacgauguauaggaguaagcaauagagacuuuguggaaggaaugucaggagggacauggguugacguagucuuagaacauggaggauguguaacggucauggcacaagauaaaccaacaguugauauagaauuaguaacaacaacaguaucaaauauggcagaaguuagaucauauuguuaugaagcaucaaucucagacauggcaagugacucaagaugucccacgcaaggugaagcauaucuagacaaacaaagugauacacaauauguaugcaaaagaacacuuguagacagaggauggggcaacggaugcggucucuuugguaagggcagcuuaguuacaugugcaaaauucgcguguaguaaaaaaaugacagguaaaucaauacagccugaaaaucuugaauaucgaauuauguuaucuguucacggaucacaacauucuggcaugauuguaaaugacacaggucacgaaacagaugaaaacagagcuaaaguagaaauaacaccgaacucaccaagagcagaagcuacuuuaggagguuuugggaguuuaggacuagauugcgaaccaagaacaggacuugauuuuagugauuuauacuauuuaaccaugaauaauaaacauuggcugguacauaaagaaugguuucaugauauuccauuaccauggcaugcaggagcugauacaggaacaccccacuggaauaauaaagaagcgcuuguagaauuuaaagacgcacaugccaaaagacaaacaguaguaguuuuagguagucaagaaggggcaguccauacagcacuagcgggagcauuagaagcagaaauggauggagcaaaaggacgauuaagcucaggacaucuaaaauguagacugaaaauggauaaauuaaggcuaaaaggaguaagcuauagucuuugcacagcagcauucacuuuuacaaaaauuccagcggaaacacuacauggaacuguaacaguagaagugcaauacgcaggaacugauggaccguguaaaguuccagcacaaauggcaguagauaugcaaacauuaacaccaguaggacguuuaauaacagccaauccaguaauaacagaaucaaccgaaaacucgaaaaugaugcuagaauuagauccuccuuuuggagauucguacauaguuauaggugucggagaaaaaaagaucacacaucacuggcauagaagcggcaguacaauaggaaaagcauuugaagcuaccguacguggagcuaaaagaauggcaguucuaggcgauacugcaugggauuuuggcucaguuggaggugcauuaaacagcuuagggaaaggaauacaucaaauuuuuggugcagcauucaaaagcuuguuuggaggaaugucaugguuuagccaaauauuaauuggaacuuuacuuaugugguuaggacuaaauacaaaaaaugguaguauaucauuaaugugucuugcauuagguggaguauugauuuuuuuaucaacagcaguaagcgcagauguaggauguucaguagacuuuuccaaaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9210 - RNA, 2365 nt, Artificial Sequence
  KX447516.1 prME-long mRNA Design 3 opt
gggagaaagcuuaccaugagaauaauaaaugcacgaaaagagaaaaagagacgaggcgcagacacaaguguaggaauaguaggccuacuuuuaacuacagcaauggcugcagaaguaacgagacgagguuccgcauauuauauguaccuugacaggaaugacgcaggggaagcaauauccuuuccaaccacauuaggaaugaauaaauguuacauacaaauaauggaucuaggacauaugugugaugcaacaaugaguuaugaauguccaaugcuggaugaaggaguagaacccgaugacguagauuguuggugcaauacuacaucaacauggguaguauaugggaccugucaucauaaaaaaggagaagcaagaaggaguagaagagcagucacauugccgagucacucaacaagaaaauuacaaacaagaucccaaacauggcuugaaucuagagaauacacaaaacaucuuauaagaguugaaaauuggauuuucagaaaccccggauucgcgcuagcagcagcagcaauagcauggcuccuuggaucauccacaaguaaaaaaguaauauacuuagugaugauauuacuaaucgcaccagcauacaguauacguugcauaggaguaucaaaucgagauuucguugaagggaugucuggagguacauggguagauguuguacuagaacaugguggauguguuacaguaauggcgcaagacaaaccuacagucgauauagaacuaguaacaacuacaguaagcaauauggcagaaguccgaucauacuguuacgaagcaaguauaucugacauggcaagcgacagucgauguccaacacaaggagaagcauaucuagauaaacaaucugacacacaauauguuugcaaaagaaccuuaguugauagaggaugggguaauggguguggcuuauuuggcaaggguagucuuguaaccugugcaaaauucgcauguaguaaaaaaaugacaggaaaaagcauacaaccagaaaaucuagaauauagaauaauguuaucaguacaugguagucaacauucaggaaugauaguuaaugacaccggacacgaaacugaugaaaaucgagcaaaaguagaaauaacaccaaauaguccacgagcagaagcuacauuaggcggauuuggaucguuaggauuagauugugaaccaagaacuggauuagauuuuagugaucuauauuaccuaacaaugaauaauaaacacugguuaguacauaaagaaugguuucacgacauaccacuacccuggcacgcuggagccgauacuggaacaccacauuggaacaacaaagaagcacuaguagaguuuaaagaugcacacgcaaaaagacaaacaguaguaguauuaggaucacaagaaggcgcaguccauacagcacuagcaggagcauuagaagcggagauggacggagcaaaaggaagacuaaguucaggccauuuaaaaugcaggcuaaaaauggauaaauuaagauuaaaaggaguaucauauucacuauguaccgccgcauuuacauuuacaaaaauaccagcagaaacuuuacauggcaccguuacugucgaaguccaauaugcuggaacagauggaccauguaagguuccagcucaaauggcaguggauaugcaaacacuaacuccaguagguagacuaauaacagcaaauccgguaauuacugaaucaacagaaaacucaaaaaugaugcuagaauuagauccuccguucggagacucguacauaguuauagguguaggugaaaaaaaaauaacacaucauuggcauagaucaggaucaaccauagggaaagcuuuugaggcuacgguaagaggagcaaaacgaauggccguuuuaggagauacugcaugggauuuuggaagcguaggaggagcauuaaacucauuaggaaaaggaauacaucaaauauuuggagcagcauuuaaaagucuauuuggaggaaugucaugguuuucacaaauacuaauaggaacucuguuaaugugguuaggacuaaauacaaaaaauggaucuauaagccuuaugugccuagcucuaggaggaguuuuaauauucuuaaguacagcuguaucagcagauguuggauguucuguagacuucucuaaaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9211 - RNA, 2365 nt, Artificial Sequence
  KX520666.1 prME-long mRNA Design 3 opt
gggagaaagcuuaccaugagaauuauaaaugcacgaaaagaaaagaaaagaagaggcgcugauacaagcgugggaauugugggauuauuauuaacaacagcaauggcagcggaaguuacaagaagaggaagugccuauuauauguaucuagauagaaaugacgcaggagaggcaaucucauuuccaacuacacuuggaaugaauaaauguuacauccaaauaauggacuuaggacauaugugcgaugcaacuaugucauacgaauguccgauguuagaugaaggaguagagccagacgauguagauugcugguguaauacaacuucaacauggguaguauacggcacgugucaucauaagaaaggcgaagcuagacgauccaggagagcaguaacauuaccuucacauaguacaagaaaauuacagacaagaucacaaacaugguuagaaucuagagaauauacaaaacaucuaauuagaguugaaaacuggauauuuagaaacccaggauucgcacuagcagcugcagcaauagcaugguuacuaggcagcucuacgagacaaaaaguaauauaccuuguuaugauacuccuaauagcaccagccuauucaauuagaugcauaggaguaaguaacagagauuuuguugaaggaaugagcggagguacauggguagauguaguauuagaacauggaggaugugugacaguaauggcacaggauaaaccaacuguagacauagaauuaguaacaacaacuguaagcaauauggcagaaguaagaaguuacuguuaugaagccucaaucagcgauauggcaagugauucaagauguccaacacaaggugaggcuuauuuagauaaacaaagcgacacacaauauguaugcaaaaggacauuaguagacagaggauggggaaacgguugcggccuauucggaaaaggaagucuaguuacaugugcaaaauuugcuuguucuaagaaaaugacaggaaaaagcauacagcccgaaaaccuagaauaucgcauaauguuaagcguacauggaucacaacauaguggaaugauaguuaaugauacaggacacgaaacagaugaaaacagagcaaaaguggaaauaacuccaaauucacccagagcagaagcaacacuaggaggauucggaucacuaggacuagauugugaaccgaggaccggauuggauuuuagugauuuguacuauuugacuaugaauaacaaacauuggcuaguacacaaagaaugguuucaugauauaccauuaccauggcaugcaggagcagauacggguacaccacauuggaauaacaaagaagcauuaguagaauuuaaagacgcacaugcaaaacgacaaacaguaguaguacuugggagucaggaaggagcaguacauacagcauuagcaggagcauuagaagcagaaauggauggugcaaaagguagacuuucauccggacaccugaaaugucgacuaaaaauggauaaauuaagauuaaaaggggugagcuacagcuuguguacugcagcauuuacuuuuacuaaaauaccagcugaaacacuucauggaacaguaacuguagaagugcaguaugcaggaacagaugguccauguaaaguaccagcacagauggcuguagauaugcaaacucuaacaccuguuggcaggcuaauaacugcaaauccaguaauaacagaaucaacagaaaacucaaaaaugauguuggaauuagauccaccauuuggagauaguuacauaguaauagguguuggggaaaagaaaauuacucaucauuggcacagaucaggaucuacgauaggaaaagcauuugaagcuacuguaagaggcgcaaaaaggauggcaguauuaggugauacggcaugggacuuuggaucuguagguggagcguugaauagucuagguaaaggaauacaucaaauauuuggagcagcauuuaaaucauuauuugguggcaugaguugguuuagucagauacuuauaggaacucuauuaaugugguuaggauuaaacaccaaaaauggaucaauaucacuuauguguuuagcauuagggggaguccuaaucuuccuaucaacagcaguaagcgcggauguaggauguucaguagauuuuagcaaaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9212 - RNA, 2365 nt, Artificial Sequence
  KU729218.1 prME-long mRNA Design 3 opt
gggagaaagcuuaccaugcguauuauaaaugcaagaaaagaaaagaaaagaagaucagcagauacaucaguugguauugugggcuuacuucucacaacagcgauggcagccgaaguaacuagaagaggaucagcuuacuacauguauuuagacaggaaugacgcuggggaagcuauaucauuuccuacaacauuaggaaugaauaaaugcuauauacaaauaauggaccuuggacacaugugugaugcaaccaugagcuaugaauguccaauguuagacgaaggaguagagccagaugauguagacuguuggugcaauacuacuuccaccugggugguauauggaacaugccaccauaagaaaggugaagcaagaagaaguagacgagcaguaacacugccaucacacaguacaagaaaacuucaaacaagaagccaaacauggcuagaaaguagagaauauacaaaacauuuaauaagaguagaaaacuggauauuuagaaauccuggauuugcuuuagcugcugcagcaauagcauggcuauugggaagcaguacaagccaaaaagucauauaccuaguaaugauacuucuuauagcaccagcauauucaauaagauguauaggaguaucaaauagagauuuugucgaaggcaugaguggaggaacauggguagauguuguuuuagaacauggaggauguguaacaguaauggcacaagauaaaccaacaguagacauagaauuaguaacaacaacagucucaaacauggcagaaguaagaucauauuguuacgaagcaucaauuucagauauggcuucagauucaagauguccuacacaaggagaagccuaccuagauaaacaaagugacacucaauacguaugcaaaagaacucuaguagauagagguuggggaaacggauguggguuauuuggaaaaggaagccucguaacaugugcaaaauucgccugcaguaagaaaaugacaggaaaaagcauacaaccagaaaacuuagaauauagaauaaugcuuaguguacacgguucucaacauucaggaaugauaguaaacgauacaggccaugaaacagaugaaaacagagcgaaaguagaaauaacaccaaauucacccagagcagaagccacacuuggaggauuuggcucauuaggauuagauugugaaccacgaacaggacuagacuuuagugaucuauauuacuuaaccaugaauaacaaacacuggcuaguacauaaagagugguuucacgauauuccacucccauggcacgcaggagcagauacuggaacaccgcauuggaauaauaaagaagcccucguagaauuuaaagaugcacaugcuaaaaggcaaacggugguaguauuaggaagucaagaaggagccguacacacagcauuggcaggggcacuagaggcugaaauggacggagcaaaaggucgauuaucaaguggacauuuaaaauguagauuaaaaauggauaaauuaaggcuaaaaggaguaucguauucauuaugcacagcagcauuuacauuuacaaaaauuccggcggaaacacuacauggaacaguaacaguagaaguacaauaugcgggaacagacgguccauguaaaguaccugcacaaauggcaguagauacacaaacuuugacaccaguaggaagacuaauuacagcaaauccaguaauaacugaaucaacagaaaauucaaaaaugauguuagaauuagauccaccuuucggagauaguuacauaguaauuggagugggggaaaagaaaauaacccaccacuggcaccgaagcgguucaacuauaggaaaagcauuugaggcaacaguuagaggcgcaaaaagaauggcgguauuaggagacacagcaugggauuucggaucuguaggaggggccuuaaacucacuaggaaaaggaauacaucaaauauuuggagcagcguuuaaaucacuauuuggugggaugucuugguuuagccaaauacuuauaggcacgcuacuaauguggcucgguuuaaauaccaaaaauggaucuauaaguuuaaugugucuagcauuaggaggaguacuaauauuuuugaguacagcagugucagcugauguaggcuguucaguagauuuuucaaaaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9213 - RNA, 2365 nt, Artificial Sequence
  KU761561.1 prME-long mRNA Design 3 opt
gggagaaagcuuaccaugagaauuauaaaugcaagaaaagaaaaaaaaagacgaggagcagacacuaauguagguaucguaggacuauuauuaacgacagccauggcagcugaaguaacccgaaggggaucggccuauuacauguauuuagauagaaaugaugcaggagaagcaauaaguuuuccaacaacguuagguaugaauaaauguuacauacaaauaauggauuuaggucauaugugugacgcaacaaugaguuacgaaugcccaauguuagaugaagguguggaacccgaugacguugauugcuggugcaauacaaccucaacauggguugucuaugggacaugucaucauaaaaaaggagaagcaagaagaaguagaagggccguuacucuuccaagccauagcacaagaaaacuccaaacuagaucacaaacauggcuagaaaguagagaauacaccaaacacuuaauaagaguagaaaauuggauauuuagaaauccaggauuugcauuagcagcagcagcuauagcauggcuauuaggaucgucuacaagucaaaaaguaauauauuuaguuaugauacuacuaauagcaccagcauacagcauaaggugcauaggcguaucaaacagagauuuuguugaaggaaugucaggaggaaccuggguagauguaguguuagaacauggagggugcgugacaguaauggcccaagauaaaccaacaguugauauagaacuugucacgacaacagugucaaacauggccgaaguaagauccuauuguuacgaagcaucaauaucggauauggcauccgauagcagauguccuacacaaggagaagcauauuuagacaaacaaagcgauacacaauauguauguaaacgaacauuaguugacagagggugggguaauggguguggacuauucgguaaagguaguuuagucacuugcgcaaaauuugcauguucuaagaaaaugacaggaaaaucaauacaaccggaaaaccuagaauacagaauaaugcuaucagugcauggaucacaacauagcggaaugauaguaaaugacacuggucacgagacagaugaaaauagagcaaaaguagaaauaacaccaaauucaccaagagcggaagcaacauuaggagguuuuggaucauugggauuagauugcgaaccaagaacaggauuagauuuuucagaucuuuauuaucugacaaugaauaauaaacauuggcuagugcacaaagaaugguuccaugauauaccccuaccauggcaugcaggugccgauaccggaacaccacauuggaauaauaaagaagcauuaguugaauuuaaagaugcucacgccaaaagacaaacaguaguaguauuaggcucacaagaaggggcaguacauaccgcauuggcuggagcguuagaagccgaaauggacggugccaaaggaagacucucaaguggucauuugaaaugcagacuaaaaauggauaaauuaagauuaaaaggaguaucauauaguuuaugcacagcugcauuuacauuuacaaaaauaccagcagaaacucuacauggaacaguuacaguugagguucaauaugcaggaacagauggaccaugcaaagucccugcacaaauggcaguagacaugcaaacacugacaccuguaggaagauuaauaacugcaaauccgguaauaacagaaaguaccgaaaacucgaaaaugauguuagaacuugauccuccguucggagacagcuacauuguaauaggaguaggagaaaaaaaaauaacgcaucacuggcauagaucaggaucgaccaucggaaaagcauuugaggccacugugaggggagcaagaagaauggcaguauuaggcgauacagcuugggauuuugguucagucggaggagcauugaauaguuugggaaaaggaauacaucaaauauuuggagcagcauuuaaaucauuauuuggugguaugagcugguucucccagauauuaauaggaacacuauuaaugugguuagguuuaaauacuaaaaauggaaguauaucauuaauguguuuagcuuuaggaggcguacuaauauuuuuaucaacggcuguuucagcagaugugggaugcucaguagacuucucaaaaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9214 - RNA, 2365 nt, Artificial Sequence
  KY317938.1 prME-long mRNA Design 3 opt
gggagaaagcuuaccaugaggauaauuaaugcuagaaaagaaaagaaaagaagaggagcagaaacaaguguaggaaucguugguuuauuauuaacaacugcuauggcagccgaaguaacaaggagagggagugccuauuacauguauuuagacagaaaugacgcaggagaagcaauuuccuucccaacuacuuuagguaugaacaaauguuauauacaaauaauggauuugggacauaugugcgaugcgacaaugaguuaugaauguccaaugcuagacgaaggagucgaaccugaugacguagacuguugguguaacaccacaaguacauggguaguauauggaacgugccaucauaagaaaggagaagcgagaagaaguaggagagccguaacauuaccaagucacagcacaagaaaauuacaaacaagaagucaaacaugguuagaaucaagagaauauacaaaacaccuaauaaggguagaaaacuggauauuuagaaauccaggauuugcauuggcagcagcagccauagcaugguuguuaggaucaaguacaagucaaaaaguaauauauuuaguaaugauauuauuaauagcaccagcauauucaauaagaugcauagguguaucaaauagagacuuuguagaagguaugaguggaggaacuuggguagauguaguuuuagaacacggaggaugcguaacaguaauggcucaagacaaaccaacaguagauauagaauuagucacuacaacaguaucaaauauggcagaagucagaagcuauuguuacgaagcaagcauuucagacauggcaucugauucacguuguccuacgcaaggagaagccuauuuagauaaacaauccgacacacaauauguauguaaaagaacccuaguagacagagguugggguaauggauguggccuauucgggaaaggaaguuuagucacaugugcuaaauuugcaugcaguaagaaaaugacaggaaaaucaauacaaccggaaaaucuagaauacagaauaaugcuaaguguacauggaagucaacauuccggcaugauagugaaugauacugggcaugaaaccgaugaaaacagagcaaaaguagaaauaacaccaaauucuccgcgugcugaagcuacacuagggggauuuggaucauuaggucuugacugugaaccaaggacugguuuagauuucucggaucuauauuaucuaacuaugaauaacaaacauuggcuuguacauaaagaaugguuucacgauauaccacuaccauggcaugcaggagcagauacagggacuccucacuggaacaauaaagaagcauuaguugaguuuaaagaugcacaugcaaaaagacaaacuguaguuguauuaggcucacaagaaggugcaguacacacagcucuagcaggggcucuagaggcggaaauggauggugcaaaaggaagacuuucaaguggacacuuaaaaugcagacuaaaaauggauaaauugagauuaaaaggaguaaguuauucuuuauguacagcagcauucacauuuacaaaaauaccagcagaaacauuacauggaacaguaacaguugaaguacaauacgcgggaacagaugggccaugcaaagucccagcgcaaauggcuguagacaugcaaacgcugacacccguagggcgacuaauuacugcaaauccaguaauaacugaaaguacagaaaacaguaaaaugaugcuggaauuagaucccccguuuggagacagcuauauaguaauaggaguaggugaaaagaaaaucacacaucauuggcauagaucagguucaacaauaggaaaagccuuugaagcaacaguuagaggagccaaacggauggcagugcuuggagauacggcuugggacuucggaucaguaggaggcgcauuaaacaguuuagggaaaggaauacaccaaauuuucggugcagcuuuuaaaaguuuauuuggaggaaugucaugguuuucucaaauauuaauaggaacuuugcuaauguggcuaggauuaaacaccaaaaauggaucaauaucacugaugugucuagcucuaggugguguauuaauauuucuaucaacagcaguuucagcagauguuggaugcucaguugauuuuucgaaaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9215 - RNA, 2365 nt, Artificial Sequence
  KY075939.1 prME-long mRNA Design 3 opt
gggagaaagcuuaccaugagaauaauaaaugccagaaaagaaaagaaaagaagaggugcagauacauccguaggaauaguaggauuacuuuuaacaacagcaauggcagcagaaguaacaagaagggguucagcauauuauauguaccuagauaggaaugacgcgggagaagcuauaucauuucccacaacccuaggaaugaauaaaugcuauauacagaucauggaccuuggacauaugugugaugcaacaaugucauacgaauguccaauguuagaugaaggaguagaaccggaugacgucgauugcuggugcaacacuacgaguaccuggguagucuauggaacaugucaucauaaaaagggagaagcaagacgaaguaggagagcagucacuuugccaagucacaguacuagaaaacugcagacaagaagucaaacaugguuagaaucaagagaauauacuaagcaccuaauaagaguugagaauuggauauuuagaaacccagguuuugcucuugcagcugcggcuauagcguggcuguuaggaucaucaacaagucaaaaaguuauauacuuagugaugauauuauuaauugcuccugcauauucacuaagauguauuggaguaaguaauagagauuuuguagaagguaugaguggaggcacguggguugauguaguacuagaacauggcggauguguuacaguaauggcacaagauaaaccuacaguagauauagaauuaguaacuacuacaguaaguaauauggcagaaguuagaaguuacuguuaugaagcaaguauaucagauauggcaagugauucaagaugucccacgcaaggagaggcuuaucuagauaaacaaucagauacacaauacgucuguaaacgaaccuuaguagaucgagguuggggaaaugggugcgguuuauucggaaaaggaucauuaguaacuugugcaaaauuugcauguucaaagaaaaugacaggaaaaagcauccaaccagaaaacuuagaauauagaauaauguuaaguguacaugguucucaacauucaggaaugauaguaaacgacacaggccaugaaacagaugaaaauagagcaaaaguagaaauaacaccaaauucaccaagagcugaagcgacuuuaggaggauuugguagcuuagguuuagauugugaacccagaacaggauuggauuucagugauuuauauuaucuaacgaugaauaacaaacauugguuaguacauaaagaaugguuccaugauauaccauugccuuggcaugcuggagcagauacaggaacgccacacuggaauaauaaagaagcauuaguagaauuuaaagaugcacacgcgaaaagacagacaguagucguacuaggaucacaagaaggagcaguacauacagcauuggccggagcuuuagaagccgaaauggauggagcaaaaggcagauuaagcaguggccacuuaaaaugucgauuaaaaauggauaaauuaagauuaaaaggagucaguuacagcuuauguacagcugcauucacauuuaccaaaaucccagcagaaacauuacaugguacugugacaguagaaguacaauacgcuggaacagauggcccuuguaaaguaccagcacaaauggcaguagauaugcaaacauuaacaccgguaggaagguuaauuacugcaaauccaguaauaacugaaucaacagaaaauaguaaaaugaugcuagaauuagacccacccuuuggggauaguuauauagugauaggaguaggagaaaagaaaauaacacaccacuggcaucguagcggaaguacaauaggaaaagcauuugaagcuacgguaagaggggcaaaacgaauggcugugcuaggggacacagccugggauuucggaucagugggaggugcauuaaauucauuaggaaaagggauacaucaaauauucggagcugcguuuaaaucauuauucggaggaaugaguugguuuucucaaauauuaauuggaacgcuucuaauguggcuaggacuaaauacuaaaaacgguucaauaucucugauguguuuagcauugggaggaguacuaauauuccuuaguacagcaguaagugcggauguaggcugcucaguagauuuuaguaaaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9216 - RNA, 2365 nt, Artificial Sequence
  KX806557.2 prME-long mRNA Design 3 opt
gggagaaagcuuaccaugagaauuauaaacgcaagaaaagaaaaaaagagaagaggagcugacacuaauguaggaauaguaggacuguuauuaacaacagcgauggcagcagaaguaacgagaagaggaucugcauacuauauguauuuagauaggaaugaugcaggagaagccauaucauuuccgacaacauugggaaugaauaaauguuacauacaaauaauggaucuaggacauaugugugacgcaacaaugaguuacgagugucccauguuagaugaagggguugagccagacgauguggauuguugguguaacacaacaaguacuuggguuguauauggaacuugccaccauaaaaaaggugaagcuagaagaucacguagggcgguaacacuaccaucucacaguacccguaaacuacaaacgagaagccagacaugguuagaaagcagagaauauacaaaacauuuaauaagagucgaaaauuggauguuuagaaauccaggcuuugcauuagcagcagccgcuauagcauggcuucuuggaucaaguacaucacaaaaaguuauauauuuaguaaugauauuguuaauagccccagcuuacucaauaagauguauuggaguaagcaacagagauuuuguagaaggaaugaguggaggaacauggguugauguaguacuagagcauggugggugcguaacagucauggcgcaagacaaaccuacaguagauauagaauuaguaacaacaacaguaaguaauauggcagaagugcgaucauauuguuacgaagcaagcauuucugauauggcaucagauagucguuguccaacacaaggagaagcauaccuagauaaacaaucagauacccaauacguauguaaaagaacuuuaguagaucgagguugggguaauggauguggacuauuugguaaaggaagccuaguuacuugugcuaaguuugcaugcaguaaaaaaaugacagguaaaucaauacaaccagaaaaucuagaguauagaauaauguuaaguguacauggaagucaacauagugguaugauuguaaaugauacaggacacgaaacagacgaaaaccgagcuaaaguagaaaucacgccaaauagucccagggcagaagcaacauuaggaggauuuggcucguuaggauuagacugugaaccacgaacugggcuagauuuuagcgauuuauauuaucuaacaaugaacaacaaacacugguuaguacauaaagaaugguuucaugauaucccacuaccuuggcaugccggagcagacacaggaacaccacacuggaauaauaaagaagcacuaguagaguuuaaagacgcacaugcgaaaaggcaaacaguaguaguacuaggaucacaagaaggagcgguacauacggcacuagcuggagcccuagaagcagagauggacggcgcuaaaggaagauugagcaguggacaccuaaaaugucguuugaaaauggauaaauuaagacucaaaggaguaaguuauucguuaugcacagcugcguuuacauuuaccaaaauaccagcagaaacgcuacauggaaccguaacgguggaaguucaauaugcaggaacagauggaccaugcaaaguaccagcucagauggcgguagacaugcaaacauuaacaccaguagggagguuaauaacagcaaacccugugauaacugaaaguacagaaaauaguaagaugaugcuagaacuagauccaccauucggagauucauauauaguaauaggaguaggggaaaaaaaaauaacucaucauuggcauagaagugguaguacaaucggaaaagcauuugaagcaacaguacgcggggcaaaaagaauggcaguacuuggagauacagcaugggauuuuggaaguguaggaggugcguuaaauaguuuaggaaaaggaauacaucaaauauucggggcagcauucaaaaguuuauuuggaggaaugaguugguucagucaaauauuaauaggaacauuguuaauguggcuaggucuuaauacaaaaaaugguucaauaaguuuaaugugucuugcauuaggaggagucuuaauauuuuuaagcacagcaguaagugcggacguuggguguucaguugacuuuaguaaaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9217 - RNA, 2365 nt, Artificial Sequence
  KU870645.1 prME-long mRNA Design 3 opt
gggagaaagcuuaccaugagaauaauaaaugcacgcaaagagaaaaaaagaagaggagcagauacaaguguaggaauaguugguuuauuacuaacaacagcaauggcagcugaagucacaagaagaggaucagcauauuauauguaccuagacagaaacgaugcuggagaagcgauaucauuuccuacgacacuugguaugaauaaaugcuauauucaaauaauggacuugggacauaugugugaugcaaccaugucauacgaaugcccuauguuagaugaggguguagaaccugacgauguagauugcugguguaacacaacuaguacuuggguaguuuauggaacaugucaccacaaaaagggagaagcaagaagaucaagaagggccguaacucucccaucacacaguacaagaaaauuacaaacaagaucacaaacgugguuagaaucaagagaauauacaaaacacuuaauaagaguugaaaauuggauacuacguaauccaggauucgcacucgcagcugcggcuauagcauggcucuuagguucgaguaccucucagaagguaauauacuuaguaaugauauuauuaauagcaccagcuuauucuauaagauguauaggagucaguaauagagauuuuguugaaggaaugucaggaggaacuuggguagacgugguacuggaacacggaggaugcgugaccguuauggcgcaagauaaaccaacgguagauauagaauuaguaacaaccacaguuaguaauauggccgagguaaggucuuauuguuaugaagccucuauaucugacauggcaucagacucaagaugcccuacacaaggagaagcauauuuagauaaacaaucagauacacaauauguauguaaacgaacacuaguagauaggggcugggguaauggaugcggacuauucggaaaaggaaguuuagucacaugugcaaaauucgcauguucuaaaaaaaugacaggaaaaucaauacaaccagaaaauuuagaauaucgaauuauguuaucaguacauggaucacaacauucuggaaugauaguaaacgacacaggccacgaaacagacgaaaauagagcaaaaguugaaauaacaccaaauaguccucgagccgaagcaacacuuggagguuuuggaagucuaggauuagauugugaaccaagaacaggauuagacuucucggaucuauauuaucugaccaugaauaauaaacauugguuagugcacaaagaaugguuucaugauauaccguuaccauggcaugccggagcagauacaggcacaccacauuggaauaauaaagaagcacuaguagaauucaaagaugcucacgcuaaaagacaaacagugguaguauuagguagccaagaaggagcaguacacacagcccuagcaggugcucuugaagcagaaauggauggagcaaagggaagauuaaguuccggacaccugaaaugcagacuaaaaauggauaaauuaagacuaaaaggagucucauauucauugugcacagcagcauuuacuuuuacaaaaauuccagcagaaacguugcacggaacaguaacuguagaaguacaauacgcaggaacagauggaccguguaaaguaccagcacaaauggcaguugauaugcaaaccuuaacaccaguuggaagauuaauaacugcaaacccaguaauaacagaaaguacggaaaauucaaaaaugauguuagaauuagauccuccauucggagauucauacaucguaauaggaauaggagaaaaaaaaauaacacaucauuggcacagaucgggaucaacaauagguaaagcauuugaagcuacaguaagaggagcaaaacggauggcaguauuaggagacacugccugggauuuuggaucaguagggggagcauuaaauucacuaggaaaaggcauccaucaaauauuuggugcugcuuuuaaaucccuauucggaggaaugagcugguucucacaaauacuuauuggaacucugcuaauguggcuaggauuaaauacaaaaaauggaagcauaagcuuaaugugucuagcucuaggaggcguucuaauuuuuuuaaguacagccguaucagcugacguaggauguucagucgauuucucaaaaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9218 - RNA, 2365 nt, Artificial Sequence
  KU729217.2 prME-long mRNA Design 3 opt
gggagaaagcuuaccaugagaauaauuaacgcuagaaaagaaaagaaaagaagaggagcugacacaagcgugggaauaguaggacucuugcuaacaacagcaauggcugcagaaguaacaagaagaggaagugcauauuauauguauuuggaucgaaaugacgcaggagaagcaauaucauuuccaacaacacucggaaugaauaaaugcuauauacaaauaauggaucucggacauaugugcgacgccacaaugucuuaugaauguccuaugcuagaugaaggaguagaaccagacgaugucgauuguugguguaauacaacaagcacaugggugguauacggaacaugucaucauaagaaaggugaagcaaggagaaguagacgggcaguaacacuaccaucacauaguacgcgaaaacuacaaacaagaucacaaacuuggcuagaaucaagagaauacacaaaacaucuaauuagaguagaaaacuggauauuuagaaacccaggcuucgcacuggcagcagcagcaauagcaugguugcuagggucaagcacaucacaaaaaguuauauauuuaguaaugauauuauugauagcuccagcauacaguauaagauguauaggagugucaaaucgagauuuuguugaaggaaugucaggaggcacuuggguagauguaguauuagaacauggugguugcguaacaguaauggcucaagauaaaccaacaguagauaucgaauuaguaucaacaacaguuucaaacauggcagaaguaagaucuuauuguuacgaagcaaccauaagcgauauagcaagugauucaagguguccuacacaaggagaagcauaucuagacaaacaaucagauacacaauacguaugcaaaagaacauuaguugauagaggauggggaaauggaugcggguuauuuggaaaagggaguuuaguaacuugugcaaaauuugcguguucaaagaaaaugacaggaaaaucaauacaaccagaaaacuuagaauaucgaauuauguugucaguacauggaucacaacauagcgggaugauagucaaugauacaggacaugaaacugacgaaaauagagcaaaaguagaaauaacaccaaauagcccuagagccgaagcuacauuaggaggauuugguucacucggacuagacugugaaccaaggacuggucuugauuuuucagauuuauauuacuuaacaaugaauaauaaacacugguuaguccacaaagaaugguuucaugacauaccauugccuuggcaugcaggagcagauaccggaacaccacacuggaauaauaaagaagcauugguagaauuuaaagacgcucaugcaaaaaggcaaacagcuguuguacucggaucucaagaaggagcaguucacacagcuuuagcuggagcacuugaagcagaaauggauggagcaaaaggaagacuaucuucgggccauuuaaaaugcagacuaaaaauggauaaauugcgauuaaaagggguuaguuacaguuuauguacagcggcuuuuacuuuuacaaaaauaccagcagaaacacuacauggaacaguaacaguagaaguacaauaugcggguacagauggcccaugcaaaguaccagcacaaauggcaguagauaugcaaacacuaacgccaguaggaaggcugauuacagcaaauccaguaauaacagaaucuacugaaaacucaaaaaugaugcucgaacuagauccaccauuuggggauucuuauaucguuauaggcguaggcgaaaagaaaauuacacaccauuggcacagaucaggaucaacaauaggaaaagccuuugaagcuacaguaagaggugcaaaaagaauggcuguucuuggagacacagcaugggauuuugguaguguagggggagcauugaacucacuagggaaaggcauacaucaaauuuuuggugcagcauuuaaaucauuauucggaggaaugagcugguuuagccaaauucuaauuggaacuuuacugauguggcuaggccuuaauacuaaaaauggaaguauaucacuuaugugcuuagcauuaggaggaguacugauauuuuuaucaacagccguuucagcagacguugguugcaguguugauuuuaguaaaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9219 - RNA, 2365 nt, Artificial Sequence
  KU497555.1 prME-long mRNA Design 3 opt
gggagaaagcuuaccaugagaauaauaaacgcucguaaagaaaaaaagagaagaggagcagacacaaguguaggcauaguaggauugcuuuugacuacagcaauggcagcagagguaacaaggagagggucagcuuauuauauguacuuagacagaaacgacgcaggugaagccauauccuuuccgacaacacuagguaugaauaaaugcuacauacaaaucauggauuuaggacauaugugcgaugcaacaaugagcuacgaauguccaauguuagaugaaggaguagaaccagaugauguugauuguugguguaacacaacuagcacauggguagucuauggcacaugucaccacaaaaaaggcgaagcuagaagauccagacgagccguaacauuaccuagucauagcacgagaaagcuacaaacaagaagccaaacaugguuagaaaguagagaauauacaaaacaucuaaucagaguggaaaacuggauauucagaaaccccgguuuugcauuagcugcagcagccauagcauggcuauuaggaaguucaacgagccaaaaaguaauauauuuaguaaugauauuacugaucgcuccagcauauucaauacgauguauagggguaagcaauagagacuucgucgaaggaaugucaggaggaacauggguagauguugugcucgaacacggugguugugucacaguaauggcacaagauaaaccaaccgucgauauagaacuaguaacaacaacaguuucaaauauggcagaaguaagaucuuacuguuaugaggcaaguauaagugauauggcgucagauucaagaugcccaacucaaggagaagcauauuuagauaaacaaagugauacacaauacguauguaaaagaacuuuaguagauagaggauggggaaauggcuguggucuauuuggcaaaggaagucuaguaacuugugcaaaauucgcaugcagcaaaaaaaugacaggaaaaagcauacaacccgaaaacuuagaauaucgaauaaugcugucaguccauggaagucaacacagugguaugauaguuaaugauacuggacaugaaacagacgaaaauagagcgaaaguagagauaacuccaaauucgcccagagcagaagcuacccuaggagguuuuggaucacucgguuuggauugcgaaccucgaacagguuuagacuuuagcgacuuauauuaccuaacaaugaacaauaaacauuggcuaguacacaaagaaugguuucaugauauaccuuuaccauggcaugcuggcgcagauacaggaacaccgcauuggaauaauaaagaagcacuaguagaauuuaaagaugcacaugccaaaagacaaacugucguuguauuagguacacaagaaggagcuguacauacagcauuagccggagcauuagaagcagagauggacggugcaaaaggccgauuaaguucagggcaucuaaaauguagauugaaaauggacaaauuacgacuaaaaggaguuucauauucauuauguaccgcagcauucacuuuuacaaaaauaccugcagagacauuacaugguacaguaacaguagaaguacaauaugcaggaacagacggaccauguaaaguaccugcucaaauggcaguagauaugcagacucuaacaccagucggcagauuaauaacagcaaaucccguaauaacagaaucgacggaaaauucuaaaaugauguuagaacucgauccuccauuuggagauaguuacauaguaauugggguaggagaaaaaaaaaucacucaucauuggcauagaaguggaucgacgauaggaaaagcauucgaagcaacaguacgaggagcuaaaagaauggcuguuuuaggugacacugcaugggacuuuggaucaguuggaggagcguuaaauagcuuaggaaagggaauacaucagauauuuggagcagcguucaaaagucucuucgguggaaugucaugguucagucaaauacugauagguaccuuauuaauguggcuaggauuaaauacaaaaaacgguuccauuagucuuauguguuuagcauuaggcggaguauuaauauucuuaucaacagcaguaucggcagacguaggauguaguguagauuucucaaaaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9220 - RNA, 2365 nt, Artificial Sequence
  KX087101.3 prME-long mRNA Design 3 opt
gggagaaagcuuaccaugagaauaauaaaugcccguaaagaaaagaaaagaagaggugcagauacaucaguggguaucguagguuuauuauuaacaacagcgauggcagcggaaguaacaagaagaggcucagcauauuauauguaccuagacagaaacgaugcgggagaagcaauaucuuuuccuacaacacuuggaaugaauaaaugcuauauacaaauuauggacuuaggacacaugugugaugcuacaaugagcuacgaauguccaauguuagaugaaggaguagaaccagaugacgucgauugcuggugcaacacuacgagcacauggguuguuuacgguacaugccaccauaagaaaggagaagcacgaagaucaagaagggcugucacguuaccgucacauucaacaagaaaauugcaaacaagaucacaaacaugguuagagucaagagaauauacaaaacauuuaauuagaguagaaaauuggauuuuuagaaauccagguuuugcacuugcagcagcugcuauagcaugguuauuaggaucaagcacaucacaaaaagucauauauuuagugaugauuuuacuaauugcacccgcauacagcauaagauguauaggaguaucaaauagagacuucguagaaggaaugucgggaggaacuuggguagauguaguauuagaacaugggggauguguaacaguaauggcucaggauaaaccaacuguugauauugaauugguaacaacaacagugaguaauauggcugaaguaagaaguuauuguuacgaagcaaguauaagugauauggcaagugauucaagguguccuacucaaggagaggcauacuuagacaaacaaucugacacucaauauguauguaaacgaacauuagucgaucgagguugggguaauggauguggucuauuuggaaaaggaucgcuaguaacaugugccaaauuugcauguaguaagaaaaugacaggaaaaaguauucaaccagagaacuuagaauaucgaauuauguuaucaguucauggaagucaacauaguggaaugauaguaaaugacaccggucaugaaacggaugaaaauagagcaaaaguugagauaacaccaaauaguccuagagcagaagcaacacuaggagguuucggaagucuagguuuagauugugaaccacgaacaggauuagacuuuagcgaucuauacuacuuaacuaugaacaauaaacacugguugguacacaaagaaugguuucaugacauaccacuaccguggcacgcuggagcugauacuggaacaccacauuggaauaauaaagaagcauugguagaguuuaaagaugcacacgcaaaaagacaaacaguaguaguauuaggaagccaagaaggagcaguacauaccgcauuggcuggugcauuagaggcagaaauggauggugcuaaagguagguuaaguucaggccauuuaaaauguagauuaaaaauggauaaauuaagacuaaaaggugucucauacagcuugugcacagcagcauucacauuuacaaaaaucccugcagaaacauugcauggaacgguaaccguagaauuacaauaugcaggcacagauggaccuuguaaaguaccagcucaaauggcaguagauaugcaaacuuuaacuccaguaggaagauuaauaacugcaaauccagugauaacggaaaguacugaaaacaguaaaaugauguuagaacuugauccgccauuuggagacagcuacauagugauaggugugggagaaaagaaaauaacccaucauuggcaccgaucaggaucaacaauaggaaaggcuuucgaagcaacaguuagaggcgcaaaacgcauggcuguauugggagauacugcaugggauuuuggaaguguagguggggcauuaaacaguuuaggaaaaggaauacaucaaauuuucggcgcagcauuuaaaucauuauucggaggaaugagcugguuuucacaaauacuuauaggaacacuacuaaugugguuagguuuaaauacuaaaaacggaaguauuucauuaauguguuuagcacucggagguguauuaauauuccuaucaacagcaguaucagcagacguaggaugcagcguagacuuuaguaaaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9221 - RNA, 2365 nt, Artificial Sequence
  KY075932.1 prME-long mRNA Design 3 opt
gggagaaagcuuaccaugagaauaauaaaugcaagaaaagaaaagaaaagaagaggagcagaaacaaguguaggaaucguuggauuauuauuaacaacagcaauggcagcagaaguaacgagacggggaucagcuuauuacauguauuuggauagaaaugaugcaggagaagcuauuagcuuuccaacaacacuggguaugaauaaauguuauauacaaauaauggacuugggucauaugugcgacgcaacaaugucauaugaaugucccauguuagaugaaggaguagaaccagacgauguagauuguugguguaauacaacaaguacauggguaguauaugguacgugccaucauaaaaagggagaagcaaggagaucaagaagggcaguaacauuaccuagccauagcacucgaaaauuacaaacaagaagucagacgugguuggaaucaagagaguauacaaaacacuuaauacggauagaaaauuggauauucagaaacccagguuucgcucuggcugccgcagcaauugccuggcuauuagggucaagcaccucacagaaagugauuuacuuaguaaugauacuauuaauagcuccugcauacagcauuagauguauaggcguuucaaaccgagacuuugucgaaggaaugucgggagguacaugggucgauguaguauuagagcacggaggaugugugacaguaauggcacaagacaaaccaacagucgacauagagcuaguaacaacaacuguaaguaauauggcagaaguuagaucauauuguuaugaagccaguauaagugauauggcuagugauuccagauguccaacacaaggagaagcauaucuugauaaacaaagcgauacacaauauguuuguaaaagaacuuuaguagauaggggaugggguaacggguguggacuauuuggaaaaggaucuuuaguuacaugugcaaaauuugcauguaguaagaaaaugacaggaaaaucaauacaaccagaaaauuuagaauauagaauuauguugucaguacaugguucacaacauagugguaugauaguaaaugacaccgggcaugaaacagacgaaaauagagcaaaaguagaaauaaccccaaauagcccgagagcagaggcaacauuggguggauuuggaagccuuggacuagauugugaaccaagaacagggcuagauuucagugaccuguacuauuuaacaaugaacaacaaacauugguuaguccauaaagagugguuccaugauauccccuuaccauggcacgcaggagcagacacgggaacaccacacuggaacaauaaagaagcauuagucgaauuuaaagaugcacaugcaaaaagacaaaccguagugguauuaggaucacaagaaggugcaguucauacagcuuuagcuggagcacuugaagcagaaauggauggcgcaaaaggaagauuaucaaguggacauuuaaaauguagauuaaaaauggauaaauugagacuaaaagguguaucauacaguuuauguacagcagcauuuacuuuuacaaaaauaccugcagaaacauuacacgguacaguaacaguagaaguacaauaugcaggaacagacggaccaugcaaagucccggcacaaauggcuguagauaugcaaacacuaacaccagugggaagauuaauuacagcaaauccaguaauaacagaaucaacugaaaauucgaaaaugaugcuagaauuggauccaccauuuggagacaguuauauaguaauugguguuggcgaaaagaaaauaacacaucauuggcauagaucaggaucaacuauaggaaaagcauuugaggcuacagugcgaggagcuaaacgaauggcaguguuaggugauacggcaugggauuuuggaaguguaggcggugcccuaaauucacuuggaaaaggcauacaccaaaucuuuggagcagcauucaaaucgcuauuugguggaaugaguugguuuagucaaauauuaaucgggacuuuauuaaugugguuaggauuaaauacuaaaaauggaagcauaucacuaauguguuuagcguuaggaggaguauuaauuuucuuaagcacagccguaucagcagaugugggaugcaguguagauuucucgaaaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9222 - RNA, 2365 nt, Artificial Sequence
  KY014317.1 prME-long mRNA Design 3 opt
gggagaaagcuuaccaugagaaucauaaaugcuagaaaagaaaaaaaaagacggggagcagauacaucaguaggaauagugggauuauuacuaacaacugcaauggccgcagaaguuacacgaagagggagugcauauuauauguaucuagaccgaaaugaugcaggagaagcaauaagcuuuccaacaacccuuggaaugaauaaauguuauauacaaauaauggauuuaggacauaugugugacgcaacaaugucauaugaaugcccgauguuagacgaagggguagaaccagacgauguagacugcugguguaauacaacaucaacauggguuguauacggaaccugccaucauaaaaaaggagaagcaagaagaaguagaagggcgguaaccuuaccuucucauucaacuagaaaacuucaaacuagaucacaaacuugguuagaaaguagggaauauacaaaacauuuaauaagaguagagaauuggauuuuuagaaauccaggauuugcauuagcagcagcagcaauagcaugguuacucgguucaucaacaagucaaaaaguaauuuacuuaguaaugauuuuacuaauugcacccgccuacucaauuagauguauaggaguaucaaauagagauuucguagaaggaaugaguggaggcacuuggguugauguaguauuagaacaugguggcuguguaacagucauggcacaagauaagccaacaguagauauagaacuaguaacaaccaccguaucaaacauggccgaaguacgaucguacuguuaugaagcaucaauuagugacauggcaucagauaguagaugucccacacaaggagaagcauaucuagauaaacaaagugauacucaauauguauguaaaagaacauuaguagaucgagguugggguaauggauguggacuauuuggaaaaggaucucuagucaccugugcaaaauuugcuuguucaaaaaaaaugacaggaaaaagcauucaaccagaaaauuuagaauauagaauuauguuaucaguacauggaagccaacauucuggaaugauaguaaaugauacuggacacgaaacagaugagaauagggcaaaaguugaaauaacaccaaauucaccuagagcagaagcaacauuaggcgguuuugguagcuuggguuuggauugugaaccuagaacaggacuagauuuuagugauuuauauuaucuaacaaugaauaauaaacauuggcugguacauaaagaaugguuucaugauauaccauuaccuuggcaugcaggagccgauaccgguacgccucauuggaacaauaaagaagcacuuguagaauucaaagaugcacacgcaaaacgucaaacaguaguaguauuaggaucacaagaaggggcaguacauacggcguuagcaggcgcauuagaagcagaaauggauggagcuaaaggucgucuuucaaguggacauuuaaaauguagguuaaaaauggauaaacuacgauuaaaaggcguaucuuauucauuauguacagcagcauuuacuuuuaccaaaauaccagcagagacccuacauggaacagucacgguagaaguacaauaugcugguacugauggaccauguaaaguaccugcucaaauggccguagauaugcaaacauuaacaccagugggaagacuaauaacagcaaauccgguuauuacagaaagcauagaaaauucaaaaaugauguuagaacuagauccacccuucggugauucauauauaguuauaggcguaggggagaaaaaaauaacgcaucacuggcaucgaucaggaaguacaauaggcaaagcauuugaagcuacuguacguggagcaaaacgaauggccguucucggggacacugcuugggacuucggcucaguaggaggggcgcuaaauagucucggaaaaggcauacaccaaauuuuuggagcagcuuucaaaucauuauucggaggaaugucgugguucagucaaauauuaaucggaacacuacuaauguggcuaggacucaauaccaaaaaugggaguauaaguuuaaugugucuagcauuaggagguguuuuaauauuuuuaucaacugcuguuucagcagacguaggaugcucaguugauuuuucaaaaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9223 - RNA, 2365 nt, Artificial Sequence
  KU758876.1 prME-long mRNA Design 3 opt
gggagaaagcuuaccaugagaauaauaaacgcaaggaaagaaaagaaaagaagaggagcugauacaucuguaggaauuguaggguuacuauuaacaacagcaauggcugcggagguaacaaggaggggcucagcauacuauauguaucuagaccgaaaugaugcaggagaagcaauaaguuucccaacaacauugggaaugaauaaauguuacauacaaauaauggauuuaggccauaugugcgaugcaacaaugaguuaugaaugcccgaugcuagaugaaggaguugaacccgaugaugucgauuguugguguaauacaacaaguacuuggguaguauacggaacaugucaucauaagaaaggugaagcuagaagaucaaggagagcgguaacacuaccgucacauucaaccagaaaauuacaaacaagaucacaaaccugguuagaaaguagagaauauacaaaacauuuaauaagaguagaaaacuggauauuuagaaauccagguuuugcauuggcugcugcagcuauagcaugguuacuaggaagcucaacaagucagaaaguaauauaucuagucaugauuuuacuaaucgcaccagccuacaguauaagguguauaggaguaucaaauagagacuuuguagaagguaugaguggagguacauggguagacguaguacuagaacacggagguuguguaaccguaauggcccaagauaaaccgacaguagacauagagcuaguaacaacaacaguuucaaauauggcugaaguuagaagcuauugcuaugaagccucaauaagcgacauggcuagugauucaagaugucccacacagggagaagcauauuuagauaaacagucagacacucaauauguauguaagagaacauuaguagacagggguuggggaaauggauguggauuauucggaaaaggaagucuuguaacaugcgcaaaauuugcauguucgaagaaaaugacaggaaaaaguauacaaccagaaaacuuagaauauagaauaaugcuuaguguacauggaagucaacauaguggaaugauaguuaaugauacuggucaugaaacagaugaaaauagagcaaaaguagaaauaacuccaaacagcccuagagcagaagcuacauuaggaggauuugguaguuuaggacuagauugcgagccuagaaccgggcuggacuuuucugauuuauauuacuuaacaaugaacaauaaacauuggcuaguacauaaagaaugguuccaugauauaccuuugccauggcacgcaggggcagauacaggaacaccucauuggaauaacaaagaagcucuaguagaauuuaaagaugcacaugcaaaaagacaaacaguuguuguauuaggaagucaagaaggagcaguacacacagcacuagcaggagcauuagaagcagaaauggauggaguaaaaggccggcuuagcagcggucaucuaaaauguagauuaaaaauggacaaacuaagguuaaaagguguaaguuauagucuguguacugcggcauuuacauuuacaaaaauaccagcagaaacauuacaugguaccguaacaguagaaguacaauacgcaggaacggauggacccuguaaaguuccugcacaaauggcaguagacaugcaaacacuaacaccuguggguaggcuaauaacugcaaauccgguaauaacagaaucaacugaaaauaguaaaaugaugcuugaauuggaucccccuuuuggagacaguuauauaguaauagggguaggagaaaagaaaauaacucaccacuggcauagaagcggaucaacuauagggaaagcguucgaagcaacaguacgaggcgcaaaaagaauggcaguauuaggagacaccgcaugggauuuugguaguguaggaggugcacuuaauagccuaggcaaaggcauacaccaaauauucggagcugcauuuaaaucauuauuuggagggaugagcugguucucacaaauauuaaucggaacauuauuaauguggcuuggacuaaauaccaaaaauggaucaauaucauuuaugugucuagcacuuggcggaguauuaauuuuucuaaguacagcaguuucagcagacguaggcuguaguguagauuucagcaaaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9224 - RNA, 2365 nt, Artificial Sequence
  KU758874.1 prME-long mRNA Design 3 opt
gggagaaagcuuaccaugcguauaauaaaugcacgaaaagaaaaaaaaagaagaggagcugacacaucaguuggaauuguaggauuauuauuaacuacagcaauggcagcagaaguaacaagacgaggaucugcuuauuauauguauuuagauagaaacgaugcgggagaagcaauaucauuucccacaacauugggaaugaauaaauguuacauacaaauuauggauuuaggacauaugugugaugcaacaaugagcuaugaauguccaaugcuagacgaaggaguugaaccugaugauguagacuguuggugcaauacuacaucaacaugggucguauauggaacaugccaucacaaaaaaggugaagcuagaagaaguagaagagcaguaaccuuaccaucccacaguacacgaaaacuacaaacaaggagucaaacaugguuagaaucaagagaauauaccaaacaucugauacgaguagaaaauuggauauucagaaacccaggauucgccuuggcagcugccgcgauagcauggcuacuaggaaguucaacuucacaaaaaguaauauacuuagucaugauacuacuuauugcgccagcauauagcauacgauguauaggagucagcaauagagauuuugucgaaggaaugucuggaggaacauggguagacguaguauuagaacauggaggauguguaacaguaauggcacaagauaaaccaacuguagauauugaauuaguuaccacaacaguaucaaauauggcagaaguaagaucauacuguuaugaagcaaguauaagcgauauggcaagugacucaagauguccaacccaaggagaagcauacuuagauaaacaaagcgauacacaauauguauguaaacgaacguuaguagacagaggauggggaaauggauguggucuauucggaaaagguaguuuagugacaugugcaaaauuugcuuguaguaaaaaaaugacaggaaaauccauucaaccagaaaaucuagaauauagaauaaugcugaguguacauggaucacaacacucugguaugauagucaacgacacuggacaugaaacugaugaaaauagggcuaaaguagaaauaacaccuaauucaccaagagccgaagcuacuuuaggugguuuuggcucauuaggcuuagauugugaaccacgaacaggauuagauuuuucagaccuauacuaccuaacaaugaacaacaaacauugguuaguucauaaagaaugguuucacgauauaccacuaccuuggcaugcaggugcagauacuggaacuccacauuggaauaacaaagaagcacuagucgaauuuaaagacgcacaugcaaaacgacaaacaguaguaguuuugggcucucaagaaggugcaguucauacagcacuagcuggugcucuagaagcagaaauggauggagcuaaggguaaacuaaguagcggacauuuaaaaugcagacuaaaaauggauaaauuacgacuaaaaggaguaaguuauucauuaugcacagcggcauucaccuuuacaaaaauaccagcagaaacauuacacggaacaguuacaguugaaguccaauaugcaggaacagauggaccauguaagguaccugcccaaauggcuguagauaugcaaacacuuacaccuguuggaagacuuauuacagcuaaccccguaauaaccgagucaacagaaaacaguaaaaugaugcuagaacuagaccccccauuuggugauaguuauauagugauagggguaggugaaaaaaaaauaacacaucauuggcauaggagcggaucaacaauagguaaagcauuugaagccacaguaagaggugccaaaagaauggcaguguuaggagacacagcaugggacuucggaucagugggcggugcacuaaacaguuuagguaagggaauacaucagauauuuggugcugcauuuaaaucuuuauuuggaggaaugaguugguuuagucaaauuuuaauuggaacacuauuaauguggcuagggcuaaacacgaaaaacggcucaauaucauuaaugugcuuagcauuagguggaguuuuaauauuucuaucaacagcaguuagugcugacguuggaugcuccguagacuucucaaaaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9225 - RNA, 2365 nt, Artificial Sequence
  KY014314.1 prME-long mRNA Design 3 opt
gggagaaagcuuaccaugagaauaauaaacgcuagaaaagaaaagaaaagaagaggagcugauacaagugucgguaucguuggacucuuauuaacaacugcaauggccgcagaagugacacgaagggguagugcauauuacauguauuuagauagaaaugaugcaggagaagcgauaucauuccccacaacacuaggaaugaauaaaugcuauauacaaauuauggauuuaggucacaugugugacgcaacaaugucauaugaauguccaauguuagacgaaggaguagaaccagaugauguagauugcugguguaauacaacaucaacaugggucguauacggaacuugucaccacaagaaaggagaagcuaggagaaguagacgagcaguaacucuaccuagucauucuaccagaaaacuccaaaccagaucacaaacaugguuggaaucaagagaauauacuaaacaccugauaaggguagaaaauuggauauuucguaacccagguuucgcauuagcagcagcagcaaucgcaugguuauuaggaagcagcacaucacaaaaaguaauauauuuagugaugauauuacuaauagcgccugcauauaguauuagauguauaggaguaucaaaucgagacuuuguugaaggaaugucaggaggaacauggguagacguaguucuugaacacggaggauguguaacaguaauggcacaagacaaaccaacgguagauauagaauuaguaacaacgacaguaucaaacauggcagaaguaagaucuuacuguuacgaagcguccauaucagauauggcaagcgauucaagaugcccaacccaaggugaagcauaucuagauaaacaaagugauacacaauauguauguaaaaggacucuagucgacagagggugggguaauggauguggacuauuuggaaaaggaucauuaguaacaugugcaaaauuugcauguucaaagaaaaugaccggaaaaagcauccaaccagaaaaucuugaauaccgaauuaugcuaucaguacauggaucacaacacucaggaaugauaguaaaugacacaggucaugaaacagaugaaaacagggcaaaaguagaaauaacaccaaauucaccuagagcagaagcaacccucggagguuuuggaucauuaggauuagauugugaaccuagaacaggacuagauuuuucagacuuauacuacuuaaccaugaacaauaaacauugguuaguacacaaagaaugguuucaugacauaccuuugccauggcacgcaggagccgauaccggaacaccacacuggaacaauaaagaggcuuuaguagaauuuaaagaagcacaugcaaaacgacaaacaguaguaguauuaggaagucaagaaggggccguacacacagcacuagcaggagcauuagaagcagaaauggauggagcuaaaggaagacuaucaaguggacauuuaaaaugcagacuaaaaauggauaaacuaagacuaaaaggggucagcuacagucuauguacagccgcauuuacauuuaccaaaauaccagcagaaacacuacacggaacaguaacaguagaaguacaauacgcaggaacugacggaccauguaaaguacccgcacaaauggcaguagauaugcagacauuaacuccagucggcagauuaauaacugcaaacccugucauaacagaaaguacagaaaauucaaagaugauguuagaacuagauccacccuucggcgacagcuauaucguuauaggagugggagaaaagaaaauaacacaucauuggcaucgaucagguaguacaauaggaaaggcuuuugaagcaacaguaagaggugccaaaagaauggcuguacuuggagauacagcaugggauuuuggaucaguagguggugcuuuaaauaguuuaggaaaaggaauacaucaaauuuuuggagcagcauuuaaaucauuauuuggaggaaugucaugguucucacaaauauuaauaggaacucuauuaauguggcucggauuaaauaccaaaaaugggucaauaaguuuaaugugccuagcauuaggggguguauuaauauuuuuaucaacagcaguaagugcagauguuggauguucagucgauuuuaguaaaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9226 - RNA, 2365 nt, Artificial Sequence
  KU926310.1 prME-long mRNA Design 3 opt
gggagaaagcuuaccaugcgaauaauaaaugcuagaaaagaaaagaaaagaagaggagcagauacuucaguuggaauaguagguuuacuucucaccacugcaauggcagcagaaguaacacguagaggcucagcauacuacauguauuuagaucgaaaugaugcaggagaagcaauaucauucccaacaacacucggaaugaauaaauguuauauacaaaucauggauuugggacauaugugugaugccacuaugagcuacgaauguccuaugcuagacgaaggaguagaaccugaugauguagauuguugguguaacacuacaagcacauggguaguuuauggcacaugucaucauaagaaaggugaagcaagaagaucaagacgagcgguuacacugccuucucacucuacaagaaaacuacaaacaagaucacaaacuugguuagaaaguagagaauacacgaaacauuuaauaagaguagaaaacuggauuuucagaaaucccggauuugcuuuagcugcagcagcuauagcuugguuauuaggaagcaguacaagccaaaaaguaauauauuuaguaaugauucuacuuauagcuccagcauauucaauaagguguauaggaguuucaaauagagauuuuguagaaggaaugucagguggaacauggguagaugucguucuagaacauggcggaugcguaacagucauggcacaagauaaaccaacaguagauauugaauuaguaacaacaacuguaaguaauauggcagaaguaagaucguauugcuacgaagcaucaauaagugauauggcaucagacucaagaugcccaacacaaggagaagcauaucuagauaaacaaucagacacgcaauauguuuguaagcgaaccuuaguagauagagguugggguaacgggugcggauuauuuggaaaaggcagucuaguaacaugcgcuaaauuugcguguaguaaaaagaugacuggaaaaucaauucaaccagaaaaucuagaauauagaauaaugcugucaguacaugguucacaacauaguggaaugauaguaaaugacacgggucacgaaacagaugaaaauagagcgaaaguagaaauaacaccaaauagcccacgagcugaagcuacauugggagguuucgguucuuuagguuuagacugcgaaccgagaacaggauuagacuucagcgaucuauauuauuuaacaaugaauaauaaacacugguuaguacauaaagaaugguuucaugacauuccauuaccauggcaugcaggagcagauacagguacaccacauuggaacaauaaagaagcauuaguagaauuuaaagaugcacaugcaaaaagacaaacaguaguaguuuuagguagucaagaaggagcaguucacacagcacuagcuggugcauuagaagcugaaauggauggugcgaaaggaagacugaguuccggacaccuaaaaugcagacuaaaaauggacaaacuaagacuaaaagguguaucauacagcuuauguacagcagcauucacauucacaaaaauucccgcagaaacauuacauggaacaguaacaguugaaguccaguacgcgggugcagaugguccuugcaaaguacccgcccaaauggcagucgacaugcaaacuuuaacaccuguaggaagauugauaacagcaaauccaguaauaacagaaucaacagaaaacaguaaaaugauguuggaacuugauccaccauucggugacaguuacauaguaauagggguuggagaaaagaaaauaacacaucauuggcauagaaguggaagcacaauaggaaaagcauuugaagcaacaguaagaggcgcaaaacgcauggcaguacuuggagauacagcuugggacuuugggagcguuggaggagcccuaaacagucuuggaaaaggaauacaucagauauucggagcugcauucaaaagucuauuuggaggaaugucaugguuuagucaaauauuaaucgguacauuauuaauguggcuaggcuuaaauacgaaaaauggaaguauaagucuuaugugucuagcauuaggugguguacuaauauuuuuaaguacugcagugagugcagacguagguuguucaguugacuucaguaaaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9227 - RNA, 2365 nt, Artificial Sequence
  KU761560.1 prME-long mRNA Design 3 opt
gggagaaagcuuaccaugagaauuauaaaugcaggcaaagaaaaaaaaagacgaggugcagauacuaacgugggaauaguaggauuauuacuaacaacagcgauggcagccgaaguaacuagacgaggaagcgcauauuauauguaucuagaucgaaaugaugcgggagaagcaauaaguuucccaacaacauuaggaaugaacaaaugcuauauacaaaucauggaucuuggacacaugugugaugcaacaaugagcuaugaauguccaauguuagaugaaggaguugaaccugaugacguggauuguuggugcaacacgacaucaacauggguaguauauggaacaugccaucacaaaaaaggcgaagccagaagaagcagaagagcaguaacguuaccuagucauagcacaaggaaauuacaaacaagaagucaaacuuggcuugaaucaagagaauacacaaagcaucucaucagaguugaaaacuggaucuuucgaaauccaggauuugcuuuagcagccgcagccauagcaugguuacuaggaucaucaacaagucaaaaaguaauauacuuggucaugauacuacuaauugcaccagcuuauaguauacguugcauaggaguaaguaacagggauuuuguagaaggaaugucuggaggaacauggguugauguaguccuagaacacggaggauguguuacgguaauggcacaagauaaaccaacaguagauauagaauuaguaaccaccacaguuucaaauauggcagaaguacgaucguauuguuacgaagcuaguauaagugacauggcaucagauucaagaugcccaacacaaggagaagccuauuuagauaaacaaagugacacacaauacguauguaaaagaacacuaguagauaggggauggggaaaugguugcgguuuauuugggaaggguaguuuaguaacgugugcaaaauuugcauguaguaaaaagaugacuggcaaaagcauccaaccugaaaauuuagaauauagaauaauguuaucaguacauggaagucaacacucaggaaugaucguaaacgauacuggacacgaaacugaugaaaaucgagcaaaaguagaaauuacaccaaacucuccacgagcagaagcaacauuaggaggauuuggaucauuaggccuagauugcgaaccccgaacaggacuagauuucagcgauuuauauuauuuaacaaugaauaauaaacauugguuaguacauaaagagugguuucaugacauaccucuaccguggcaugcaggagcagauacugguacaccacauuggaauaauaaagaagcacuggucgaauucaaagaugcacaugcaaaacgacaaacaguaguaguauuaggcagucaagaaggagcgguacauacagcacuagcaggagcccuagaagcagaaauggacggugcaaaaggaagauuaaguaguggacaucugaaauguagauuaaaaauggauaaacuaagauuaaaaggagucucauauucauuauguacagcagcauuuacauuuacaaaaauacccgccgaaacauuacauggaacaguaacaguggaaguacaauaugcuggaacagauggaccuuguaaaguuccagcucaaauggcaguagacaugcaaacauuaacacccguagguagacuaauuacagcaaacccuguaauaacagaaagcacagaaaacucaaaaaugaugcuagaauuagaucccccauuuggugauaguuauauuguuauaggaguuggagaaaaaaaaauaacacaucauuggcacagauccgguucgacaauuggaaaagcauuugaagcuacuguaagaggugcaaggcggauggcgguauugggagacacugcuugggacuucggaucaguuggaggagcacuaaacucacuaggaaaagguauacaucaaauuuuuggugcagccuuuaaaucauuauucggaggcauguccugguucucacaaauacuaauagguacacuucuaaugugguuaggacuaaauacgaaaaauggaucaauaagcuuaauguguuuagcccuagggggaguccuaauauucuuaucaacugcaguaucagcagauguagguuguaguguagauuuuucuaaaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9228 - RNA, 2365 nt, Artificial Sequence
  KY317939.1 prME-long mRNA Design 3 opt
gggagaaagcuuaccaugagaauaauaaaugcaagaaaagaaaaaaaacgccgaggagcagaaacuaguguagggauaguagguuuacuuuuaacaacagcaauggcagcagaaguuacaagaagaggaagugcuuauuauauguauuuagaccgcaaagaugcaggagaagcaauaaguuuucccacaacguuggguaugaauaaauguuacauacaaauuauggacuuaggacacaugugcgaugcaacuaugagcuacgaaugcccuaugcuagaugaaggggucgaaccagaugacguugauuguugguguaacacaacaucaacauggguagucuaugguacaugccaucauaaaaaaggugaagcucgacgaucaagaagagcaguaacacuaccuagucauaguacuagaaaacuacaaacaagaagucaaacauggcuagaaaguagagaguauacaaaacaccuaauaagagucgaaaauuggauuuuuagaaacccaggauuugcauuggcggcagcugcuauugcaugguuacuaggaaguucaacuucacaaaaaguuauauaucuaguaaugauacuauuaauagcaccugcguauucaauuagauguauaggaguuucgaauagagauuuuguagaagggaugucagguggaacauggguagacguaguacuagaacacggaggauguguaacagucauggcacaagauaaaccaacaguugacauagaauuaguaacaacaacaguuaguaauauggcagaagucagaucauauugcuaugaagccagcauaucugauauggcaagcgacucaagauguccaacacaaggugaagcguaucuugauaaacaaucagauacccaauauguauguaagcgaacauuaguagauagaggguggggaaauggaugcggacuguuuggaaaaggaagucuagugacaugcgcaaaauucgcauguucaaaaaaaaugacaggaaaaagcauacaaccggaaaauuuagaauauagaauaauguuaaguguacaugguucacaacauaguggaaugauagucaaugauacuggacacgaaacagaugaaaaucgagcaaaaguugaaauaaccccuaauucaccaagagcagaagcuacauuaggagguuuuggaagucuaggauuagacugugaaccaagaacagggcuagacuuuagcgauuuauauuauuuaacaaugaauaauaaacauugguugguacauaaagaaugguuucacgacaucccacuaccguggcaugcuggagccgacacugguacaccacauuggaauaauaaggaagcauuaguagaauuuaaagaugcacacgcaaaaaggcaaacaguuguagucuugggcagucaggagggagcaguucauaccgcucuagcuggagcauuagaagcagaaauggauggagcaaaagguagauuaucaucuggacaccuaaaauguagacuuaaaauggacaaauugagacuuaaaggugucucauauuccuuauguacagcugccuuuacauuuacaaaaaucccagcugaaacauuacauggaacagugacaguggaaguacaauacgcaggaacagauggaccuuguaaaguuccagcacaaauggcaguugauaugcaaacacuaacaccaguuggcagauuaauuacggccaacccagugauaacagaaaguacagaaaauucaaagaugauguuagaacuagauccuccuuuuggagauucauauauugucauaggaguaggagaaaaaaaaauaacucaucauuggcauagaucaggaucaacaauaggaaaagcauucgaagcaacaguuagaggagcuaaaaggauggccguacuaggagacacagcaugggauuuuggaucagugggaggagcauuaaacucauugggaaaagggauacaccaaauuuuuggcgcagcauuuaaaucuuuauuugggggcaugucuugguucagucaaauauuaauuggaacacugcucauguggcuuggacuuaauacaaaaaacggaucaauaagcuuaaugugucuugcauuaggaggaguucuaauauuuuuaaguacugcaguaucugcagauguaggauguaguguggauuucaguaaaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9229 - RNA, 2365 nt, Artificial Sequence
  KY075937.1 prME-long mRNA Design 3 opt
gggagaaagcuuaccaugagaauaauaaacgcaagaaaggaaaaaaaaagaagaggagcagauacaaguguaggaauaguaggcuuacuacuuaccacagcaauggcugccgaaguaacaagaagaggaucagcauauuacauguauuuagauagaaacgaugcaggagaagcaaucucuuuuccaaccacacucgggaugaacaaauguuacauacaaauaauggacuuaggacauaugugugaugcaacuaugaguuaugaauguccuaugcuagaugagggggucgaaccugaugauguugauuguugguguaauaccacuagcacauggguaguguaugguacaugucaucacaaaaaaggugaagcaagaagaucaagaagagcaguaacauuaccaagucauagcaccagaaaauuacaaacaagaucgcaaacaugguuagaaaguagagaauauacuaaacaucuaauaaggguagaaaacuggauauuuagaaauccaggcuuugcauuagcagcggcugcaaucgcaugguuacuagguaguucaacaucacaaaaaguuauauaucuaguuaugauacuauuaauagcaccagcauacucaauaagaugcauaggaguaaguaauagagauuucguagaagguaugagugggggcacauggguugacguuguuuuagaacaugguggauguguuacuguaauggcacaagacaaaccaacuguagauauagaacuaguaacgacaacaguaucaaacauggcugaagugagaucauauuguuaugaagccaguauaagugauauggucagugauucaagauguccaacacaaggugaagcauauuuagauaaacaaucagacacucaauacguuuguaaaaggacucucguagacagaggauggggaaacggauguggauuauuugguaaagggucuuuaguaacaugcgcaaaauuugcguguagcaagaaaaugaccggaaaaaguauucaaccugaaaauuuagaguauagaauuaugcuaaguguacacggaagucaacauucagguaugauaguuaacgauacaggucaugaaacagaugaaaauagagcuaaaguagaaauaacaccaaauucacccagggcagaagcaacauuagggggcuucggaucauuaggacuagauugugaaccucgaacugggcucgauuuuagugaucuuuauuauuugacaaugaauaauaaacacuggcuugugcauaaagaaugguuucacgauauaccauuaccauggcacgccggagcggauacaggaacuccacauuggaacaacaaagaagcauugguagaauuuaaagacgcccaugcuaaaagacaaacagucguaguacuaggaucucaagaaggugcaguacauacagcgcuagcaggagcguuagaagcggaaauggauggugcuaaaggaagauuaagcagcggacaucugaaaugcagauuaaaaauggacaaauuaagauuaaaaggagucucauauucauuauguacagcugcauuuaccuucacaaaaauaccagcagagacuuugcaugguacaguaacaguagaaguacaauaugcuggaacagacggucccuguaaaguaccugcacaaauggcgguagauaugcaaacacuaacucccguaggaagacuaauaacagcuaauccgguuauaaccgaaaguacugaaaauagcaaaaugauguuagaauuggacccaccauuuggagauaguuauauuguuauagguguaggcgaaaaaaaaauaacucaccauuggcauagaagugguaguacaauaggcaaagcauucgaagcaacuguaagaggagcaaaaagaauggcuguacuaggcgauacagcaugggauuucgguagcguaggaggagcacuaaacucuuuagguaaagguauucaccaaauauuuggugcagcauuuaagucccuauucggaggaaugagcugguuuagucaaaucuuaauaggaacucuacuaaugugguuaggacuaaauacaaaaaaugguaguauaaguuuaaugugcuuagcacuuggaggaguauuaauuuuucuaagcacagcaguaucagcagacguuggaugcucuguagauuucucaaaaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9230 - RNA, 2365 nt, Artificial Sequence
  LC191864.1 prME-long mRNA Design 3 opt
gggagaaagcuuaccaugagaauuauaaaugcccgaaaagaaaagaaaagaagaggagcagauacaaauguagguauagucggccuacuacuaacaacagcaauggcagcagaaguuacacgccguggaucagcuuauuauauguaccuagauagaaaugaugcaggagaagcgauuaguuuuccgacaacauuagguaugaauaaauguuacauacaaauaauggaccugggacacaugugcgacgcuacaaugagcuaugaaugcccaaugcuagacgaaggaguagaaccagaugacguagacugcugguguaauaugacaucaacaugggucguauauggaacaugccaucauaagaaaggagaagcaagaagaucucggagagcgguaacucucccaagucauaguacuagaaaacuacaaacaagaucucaaaccuggcuagaaucaagagaauauacuaaacaucuaauaagaguagaaaauuggauauuuagaaacccugguuucgcccuagcagcugcugcaauagccuggcuacuaggaaguaguacaagccaaaaaguaauauauuuaguaaugauauuacucauugcuccggcguauaguauuagauguauuggaguaaguaauagagacuucguagaaggaaugucgggaggcacauggguagauguaguacuagaacauggaggauguguaacgguuauggcucaagauaaaccaacaguagauauagaauuagucacuacaacaguaucaaauauggcagaaguaagaucuuacuguuaugaagcaucaauaagugauauggcuagcgacucuagaugcccaacccaaggagaagcauacuuagauaaacaaucagauacacaauauguauguaaaagaacauuaguagacagaggguggggaaauggauguggauuauucggaaaaggaucccuaguaacaugcgcaaaauuugccuguucaaagaaaaugacaggaaaaucaauacaaccagaaaacuuagaauauagaauaauguuaaguguacacgguucacaacauucaggaaugauaguaaaugauaccggucaugaaacugaugaaaauagagcaaaaguggaaaucaccccaaauucaccaagggcagaagccacucuaggaggguuugguucacuaggacuugauugugaaccaagaacaggacuagauuuuucagauuuauauuauuuaaccaugaauaauaaacauugguuaguucauaaagaaugguuucaugauauuccccuuccauggcaugcaggagcagacacaggaacaccucauuggaacaacaaagaagcucuaguagaauuuaaagaugcacacgcaaaaagacaaacuguagucguucuaggaucacaagaaggagcaguacacacagcacuagcaggagcacucgaagcagaaauggauggagcaaaaggacgacuaagcaguggacauuuaaaaugucgacuuaaaauggauaaauuaagauuaaaaggaguaaguuacucauuauguacagcagcauuuacauucacaaaaauacccgcagaaacccuacauggaacaguaacuguggaaguccaauacgcuggcacagauggaccauguaaaguaccagcucaaauggcaguagacaugcaaacauuaacuccaguagguagauuaauaacugcaaauccugucauaacagaaucaacggaaaacuccaaaaugauguuagaacuagacccaccauuuggagacaguuauauaguuauagguguaggugaaaagaaaauuacacaucauuggcauagaaguggaucaaccauaggaaaagccuuugaagcaacaguaagaggagccaaaaggauggcaguacuuggagacacagcaugggacuuuggaagcguaggaggagcauuaaacagccugggaaaaggaauacaucaaauauucggagcagcauuuaaaagccuuuuuggagguaugucgugguucucccaaauccuaauuggaacucucuuaauguggcuaggacuuaauaccaaaaacggaucaauaucauuaaugugucuagcauuaggagguguacuaauauuucuaaguacagcaguaucagcagacguaggauguucaguagacuucucaaaaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9231 - RNA, 2365 nt, Artificial Sequence
  KX447517.1 prME-long mRNA Design 3 opt
gggagaaagcuuaccaugagaauaauaaacgcuaggaaagaaaaaaaaagaagaggggcagacacaaguguagggauagucggacuauuauuaacuacagcaauggcagcagaaguuacaaggagagguucugcauacuauauguauuuagaucgaaaugacgcaggcgaggcuauaaguuuucccacaacucucggaaugaauaaauguuauauucaaauaauggaucuuggacacaugugugaugcaaccaugucauaugaauguccaauguuagaugaaggaguagagccagacgauguagacuguugguguaacacuacaucaacuuggguaguuuacggaacaugucaucauaaaaaaggagaagcgagaaggaguagaagagcaguaacauuaccuucacauucaaccaggaaauuacaaacaagaagccaaaccugguuagaaucaagagaauauacaaagcauuuaauacgcguggaaaacuggauauuuaggaacccaggcuucgcuuuagcagcggcugcgauagcauggcuccucggaucaucaacgucacaaaaaguaauauauuuaguaaugauuuuauugauagcaccagcauauucaauacgauguauuggcgugucaaaucgagauuuuguugaaggaauguccggaggaacuuggguagauguaguauuagaacauggaggauguguaacaguaauggcacaagacaaaccuacaguugauauagaauuaguaacaacaaccguaucaaauauggcagagguaagaagcuauuguuaugaagcuucaauaucagauauggcuucagauagcagauguccaacacagggagaagcuuaucuagacaaacaaucagacacacaauauguauguaaaaggacacuaguagauagagguuggggaaaugguuguggucuuuucgguaaaggaagcuuaguaaccugcgcaaaauuugcuuguaguaaaaaaaugacuggaaaaagcauucaaccagaaaauuuagaauauagaauaauguuaaguguacacggcucucagcauagcggaaugauaguaaaugauaccggccacgaaacugacgaaaauagagccaaagucgaaauuacuccuaauucuccaagggcugaagcugcauuaggugguuuuggaucgcuaggccuugacugcgaaccaagaacaggauuagacuucagugaucuauauuauuuaaccaugaauaauaaacacugguuaguccauaaagaaugguuccaugauauaccgcuaccauggcacgcaggugcagauacagguaccccacacuggaauaauaaggaagcauuagucgaauuuaaagaugcacacgcgaaaagacaaacaguaguaguauuaggaucacaagaaggggcuguacacacagcacuagcuggagcacuagaagcagaaauggauggugccaaaggcagauuaaguaguggacaucuuaaauguagacuuaaaauggauaaauuacgacuuaaagguguaaguuauucacuauguacagcagcauuuacuuuuacuaaaauuccagcagaaacacuucauggcaccguaacuguugaaguacaauacgcaggaacugaugguccuuguaaaguuccagcacaaauggcaguggauaugcaaacauuaaccccaguaggcagauugauaacugcaaauccgguaauuacagaaaguacagaaaacaguaaaaugaugcuugagcuugauccaccauuuggggacucuuacauaguaauaggagucggugaaaaaaaaauaacacaccacuggcacagaucagguucaacuauaggaaaagccuucgaagcuacaguaagaggugcaaaaagaauggcaguauuaggagauacagcaugggacuucggaucuguaggaggagcauuaaauucauuaggaaaaggaauacaucaaaucuucggagccgcauuuaaaagucuauucgguggaaugucuugguuuagccaaacauuaauaggcacuuuauuaauguggcuagguuuaaauacaaaaaaugguucaauuaguuuaauguguuuagcauuaggagguguacuaauauucuugaguaccgcaguaucagccgaugucgguuguucuguagauuuuagcaaaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9232 - RNA, 2365 nt, Artificial Sequence
  KU922923.1 prME-long mRNA Design 3 opt
gggagaaagcuuaccaugaggauuauaaacgcacgaaaagaaaaaaaaagaagaggggcagaaacaagcguaggaauuguaggucuacuauuaacaacagcuauggcugcugaaguaacacgaagaggaucagcauauuacauguauuuagauagaaaugaugcgggagaagcaaucucauucccuacaacguuagggaugaauaaauguuauauccaaauaauggaucuaggccacaugugcgaugcuacaauguccuaugagugcccaaugcuagaugaaggaguagaaccagaugauguagauuguugguguaauacaacaaguacauggguaguauaugguacaugucaccacaaaaaaggagaagcgaggcggucaaggagagcaguuacauuaccaucacacaguacaagaaaacuacagacacgaucacaaacaugguuggaaaguagggaauacacuaaacaucuaauacguguugaaaauuggaucuuuagaaacccaggguucgcucuagcagcggcagcuauagcaugguuacuagguucuucaacaucgcaaaaaguaauauaccucguaaugauucuacuaauagccuuagcuuacucaauaagaugcauaggcguauccaauagagauuuuguagaaggaaugucaggaggaacuuggguagauguaguuuuagaacacggaggcuguguaacaguaauggcacaggacaaaccuacaguagauauagaauuaguaacaacaacaguaucuaauauggcagaaguucgaucauauuguuaugaagcaucgauuucagauauggcaagcgauaguagauguccuacgcaaggugaagcauauuuagauaaacaaucugauacucaauauguaugcaaaagaacauuaguagauagggguuggggaaauggauguggacuauucggaaaaggaagcuuggucacuugugcaaaauuugcauguucaaaaaaaaugacaggaaaaucaauacaaccagaaaacuuagaauacagaauaaugcugagcguacauggaagccaacauagcggaaugauaguaaacgacacaggacaugaaacagaugaaaacagagcaaaaguagaaauaacucccaauucaccaagagcagaagcaacucucggaggauucggaagcuuaggacuagacugugaaccgagaacaggucuagacuucucugaucucuacuaucuaacuaugaauaacaaacauuggcuaguucauaaagaaugguuccaugacauaccauuaccauggcaugcuggagccgauacaggaacaccacauuggaacaauaaagaagcucuaguugaauuuaaagaugcacaugcaaaaagacaaaccgucguuguauuaggaucacaagagggagcuguccauacagcauuagcaggagcauuagaagccgaaauggauggagcaaaaggaagacuaucaucaggacauuugaaauguagauuaaaaauggauaaauuaagacuaaaagggguaucauacucacuauguaccgcagcauuuacauuuaccaaaauaccagcagaaacauuacauggaacaguuacaguggaaguccaauaugccggaacugaugguccaugcaagguacccgcccaaauggcaguagacaugcaaacacuaacaccagugggaagauuaauaaccgccaauccaguaauuacagaaucaacagaaaauucaaaaaugaugcucgaauuagauccgccauucggagauagcuacauuguuauuggaguaggagaaaaaaaaauuacacaccauuggcaccgaagcggaagcacuauuggaaaagcauuugaagcuacuguaagaggagcaaaacgaauggcaguacuuggagauacugcuugggauuuuggaaguguagguggcgcacuaaacagcuuagguaaaggaauacaucaaauauucggcgccgcauucaaaagcuuguuugggggaaugucaugguucucacaaauauugauagguacacuuuugauguggcuaggacuaaauacaaaaaacgguucaauaagucuuaugugucuagcccucgguggaguacuuauauuuuuaaguaccgcaguaagcgcagauguuggcuguaguguagacuuuucaaaaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9233 - RNA, 2365 nt, Artificial Sequence
  KY003156.1 prME-long mRNA Design 3 opt
gggagaaagcuuaccaugagaauaauaaaugcgagaaaagaaaaaaaaagaagaggagcugauacaaguguuggaauugugggucucuuauuaacaacagcaauggcagcagaaguaacaagaagagggucagcauacuauauguaucuagauaggaaugaugccggcgaagcuauaucauuuccuacaacauuaggaaugaauaaaugcuauauacaaauaauggaucuuggucauaugugugaugcaaccaugaguuaugaauguccgauguuggacgaaggaguugaaccagaugauguagacugcugguguaauacaacaaguacaugggucguauauggcacaugucaucauaaaaaaggagaagcgagaagaucgcguagagcuguaacacuaccaucacauaguaccagaaaacuacaaacgagaagucaaacauggcuagaaucaagagaauauacaaaacacuuaauacgaguagaaaauuggauauuuagaaacccaggauucgcauuagcagcagcggcaauugcaugguuauuaggaucaaguacgagucaaaaaguaauauauuuaguaaugauacuauuaauagcaccugcauacucaauaagauguauaggaauaaguaaucgagauuucguggaaggaaugucaggagguacauggguagauguaguucuugaacauggaggauguguaacuguaauggcccaagacaagccaacaguagauaucgaauugguaacaacgacaguuaguaauauggcagaaguacgaaguuauuguuacgaagcaucuauuucugauauggcaucagacaguagauguccaacacaaggagaggcuuaucuggacaaacaaagugacacacaauauguauguaaacguacgcuaguugaucgaggauggggaaacggauguggguuauucggaaaagggaguuuaguaacaugugcaaaauuugcauguucgaaaaagaugacgggaaaaagcauacaaccagagaauuuggaauauagaauaaugcuaagugugcacggaucacaacacucagguaugauagucaaugauacuggacaugaaaccgaugaaaaucgugcaaaaguagaaauuacaccaaauaguccaagagcagaagcaacacuaggcggauucgggauauuaggauuagauugugaaccaagaacaggacuagauuuuagcgaucuauacuacuuaaccaugaauaacaaacauugguuaguacauaaagagugguuccaugauaucccucuuccauggcacgcuggugcagauacaggaacaccacauuggaacaacaaagaagcacuaguagaauuuaaagaugcacacgcaaaaagacaaacaguaguaguauuaggaagccaagagggagcaguacauacagcacuagcaggugcauuagaagcagaaauggacggagcgaaagguagauugaguaguggacauuuaaaaugcagauuaaaaauggacaaacuaagacuuaaaggaguaaguuacagucuuuguacagcagcauuuacuuucacaaaaauaccagcugaaacacuucauggaacaguuacuguagaaguucaauaugcagguacagauggaccauguaaaguacccgcacaaauggcaguagauaugcaaacccugacaccaguaggcagacuaauaacagcgaacccaguaauaacagaaagcaccgaaaacucaaaaaugaugcuagaauuagacccaccauuuggagacaguuauauaguuauagguguuggagaaaaaaaaauaacacaucacuggcacagaagugguaguacaauaggcaaagcauuugaagcuacugucagaggcgcaaaaagaauggccguauuaggagauacagcaugggacuuugggagcguuggaggugcauugaauagccucgguaaagggauccaucagauauuuggagcagcauuuaaaagcuuauucggaggaaugucaugguucucacaaauauuaauugguacauuauuaaugugguuagguuugaacacaaagaaugguucaauuucauuaaugugcuuagccuuaggaggaguauuaauauuucuuaguacagcaguaucggcugauguuggauguuccguagauuuuaguaaaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9234 - RNA, 2365 nt, Artificial Sequence
  KU312313.1 prME-long mRNA Design 3 opt
gggagaaagcuuaccaugagaauaauaaaugcaagaaaagaaaagaaaagaagaggagcagauacaaguguaggaauagugggucuauuauuaacgacugcaauggcagccgaagugacaagacgaggaagcgcauauuauauguaucuagauaggaaugaugcuggagaagcaauuucauuuccaaccacuuuaggaaugaauaaaugcuauauucaaauaauggaucuaggacauacaugugaugcaacaaugaguuaugaauguccaauguuagaugaaggcguagaaccagaugacguagacuguugguguaauacuacaaguacuuggguagucuauggaacaugccaucauaagaaaggagaagcucgacggucacguagagccguaaccuuaccuucucacucaauaagaaaauuacaaacacgaagucaaacauggcuagaaagcagagaauauacaaaacaucuaauacgagucgaaaauuggauauuucgaaauccgggauuugccuuagccgcggcagcaauagcgugguuacucgguaguucaacaucacaaaaaguaauuuacuugguaaugauacugcuuauagccccagccuacucaauaagauguauaggaguaaguaauagagauuuuguugaaggaaugucaggcggaacuugggucgauguaguauuagaacacggcgguugugugacaguuauggcccaagacaaaccaacaguagauauagaauuaguaacaacuacaguauccaauauggcagaaguaagaaguuauuguuaugaagcaucaauaucggauauggcauccgauaguagaugucccacacaaggagaagcauaucuagauaaacaaucagacacacaauauguauguaaacgcaccuuaguagacagagguuggggaaacggauguggauuauuuggaaaaggaagucucgugacuugcgcuaaauuugcauguagcaagaaaaugacaggcaaaaguauacagccagaaaauuuagaauauagaauaauguuaaguguacauggaagucaacauaguggaaugauuguaaaugauacaggacaugaaacagaugaaaacagagcaaaagucgaaauaacaccaaacucaccacgagcagaagccacacuaggaggauuuggaagccuaggcuuagauugugaaccaagaacaggacuagacuuuucagauuuguacuauuuaacuaugaauaauaaacacuggcuaguucauaaagaaugguuccaugacauaccauuaccauggcacgcuggugcagauacagggacaccacacuggaauaauaaagaggcuuugguagaauuuaaagaugcucacgccaaaagacaaacaguaguaguauuaggaucacaagaaggagcuguacauacagcauuagcuggugcguuagaagcagaaauggauggagcaaaaggucgauuaagcucaggacacuuaaaauguagauuaaaaauggacaaauuaagacuaaaagguguaucauauagucuaugcacagcugcauucacauucacaaaaauacccgccgaaacacuucaugguacagucacagucgaaguccaauaugcaggaacugauggaccaugcaaaguaccugcgcaaauggcuguagacaugcaaacgcuaacuccaguaggaagauuaauaacagcaaauccagucauuacugaaucaacugaaaauaguaaaaugaugcuagaauuagauccaccauuuggugauuccuauauaguaauaggcguaggugaaaagaaaauaacucaucauuggcacagaagugggucaacuauaggaaaggcuuucgaagccacaguaagaggugcaaaaagaauggcaguauuaggagacacagcaugggacuuuggaaguguaggaggagcauuaaacagucuagguaaaggaauacaucaaauauuuggagcagcauucaaaucauuauucggcggaaugagcugguuuucacaaauauuaauaggaacccucuuaaugugguuaggacuaaaugcuaaaaauggaucaauuucacuuaugugucucgcacuaggaggaguccuaauauuuuugucgacagcaguaucagcagauguagguuguucuguggacuuuucaaaaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9235 - RNA, 2365 nt, Artificial Sequence
  KY075935.1 prME-long mRNA Design 3 opt
gggagaaagcuuaccaugagaaucaucaaugcuagaaaagaaaaaaaaagacgcggggcagauacaaguguuggaauuguaggauuguuacuaacaacagcaauggcagcagaaguaacaagacgagggagugcauauuacauguaucuagauaggaaugaugcaggggaagcuauaagcuuuccaacaacucuagguaugaauaaaugcuauauacaaauaauggaccugggucauaugugugaugcaacaaugagcuaugaauguccaauguuagaugaaggaguagaaccagaugacguagacuguuggugcaauacaacaaguacauggguaguauauggaacaugucaucauaaaaaaggagaagcacaacgaagcagaagagcuguaacacuaccaagccacucuacuagaaaauuacaaaccagaucacaaacguggcuggaaucacgugaauauacaaaacaucuuauuagaguagaaaauuggauauucagaaauccgggguuugcauuagcagcagcugcaauagcaugguuacuagguaguucuacuucccaaaaagucauauacuuaguuaugauauuauuaauagcaccagcuuacagcauacgauguauaggcguuaguaauagggauuuuguagaagguaugucaggaggcacauggguagauguaguuuuagaacacggcggaugugucacuguaauggcgcaagacaagccaacaguagacauagagcuuguuacaacaacgguaucaaauauggcagaagugaggucauauuguuacgaggcaucaauaagugauauggcaucagauucaagauguccaacacaaggagaggccuauuuagauaaacaaagcgauacacaauacguaugcaaaagaacacugguugauagaggauggggaaauggauguggacuguuuggaaaaggaaguuuagugacaugcgcgaaauuugccuguuccaaaaaaaugacaggaaaaagcauacaaccagagaauuuagaauauagaauaauguuaagugugcacggaagucaacacaguggaaugauuguaaaugacacaggucacgaaacagaugaaaauagagcuaaaguggaaauaacgccuaauucaccaagggcagaagcaacauuaggaggauucggaaguuuagggcuagacugugaaccaaggacaggguuagauuuuagcgaucuguauuaucugacgaugaacaacaaacauugguuaguacauaaagaaugguuccacgauauaccauuaccguggcaugccggagcagacaccggcacaccacauuggaauaauaaagaagcauuaguagaauuuaaagacgcacaugcaaaacgucaaacaguaguaguucuaggaagucaagaaggugcaguacacacugcauuagccggagcacuagaggcggaaauggacggagcaaaaggucgacuuucaaguggucaucuaaaauguagauuaaaaauggacaaacuucgacuaaaaggaguaucuuauaguuuaugcacagcagcauucacauuuacgaaaauuccagcagaaacauuacauggaacagugacuguagagguacaguacgcgggaacagauggaccauguaaagugccagcacaaauggcaguugacaugcaaacauugacaccaguaggacgacucaucacagcaaaucccguaauaaccgaaucaacggaaaauucaaaaaugauguuggaauuagacccaccauuuggggacaguuauauuguaauaggaguuggagaaaaaaaaauuacucaucacuggcacaggagcggaucaacaauagguaaagcguucgaagcaacuguucgaggagccaaacgaauggcaguauuaggagauacagcaugggauuuugguucaguaggaggagcauuaaacaguuuaggaaaaggaauacaccaaauauuuggagcggcauuuaagucauuguuuggagggaugucaugguucucacaaauacuaauaggaacacuguuaaugugguuaggauuaaauaccaaaaacggcaguauuaguuuaaugugcuuagcacuaggaggaguguuaauauucuuaaguacugcuguaagugccgauguaggcuguagugucgacuuuagcaaaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9236 - RNA, 2365 nt, Artificial Sequence
  KY014320.1 prME-long mRNA Design 3 opt
gggagaaagcuuaccaugagaauaauaaacgcaagaaaagaaaaaaagagaagaggagcagauaccaguguagguauuguaggucuguuauugacaacagcuauggcagcagaaguaacaagaagaggaagugcuuauuacauguauuuagauagaaaugaugcaggagaagcaauaucauucccaacaacauuaggaaugaauaaaugcuauauacagauaauggacuuaggacacaugugugaugcaacuaugucguaugaauguccaaugcuagaugaaggaguagaaccggaugauguugauugcugguguaauacaacgucaacauggguaguuuauggaaccugucaucauaagaaaggggaagcuagacguucaagaagagcaguaacccuaccaucacacagcacgcgaaaauuacaagcaagaucacagacuugguuagaaucacgagaauauacgaaacacuuaauacgaguagagaauuggauauuuagaaauccaggauuugcauuagcagcagccgcuauagcaugguuacuuggaucaucaacaucccaaaaaguaaucuaccuaguaaugauacuauuaauagcaccagcuuauaguauuagauguauaggaguaaguaauagagauuuuguugaaggaaugagugguggaacguggguagauguaguauuagaacauggcggauguguaaccguuauggcacaagacaaaccaacaguggacauagaacuaguuacaacaacuguaagcaacauggcggaaguaaggucauauuguuacgaagcuagcauaagugacauggcaucagauaguagauguccaacacaaggcgaagccuaucuagauaaacaaucagacacacaauauguauguaagagaacacuuguagaucguggauggggaaacgguuguggauuguuugguaaaggaucacuaguuacuugugcaaaauucgcauguaguaaaaaaaugacgggaaaaagcauacaaccagaaaauuuagaguacagaauaaugcugaguguucaugguucacaacauucaggaaugauaguaaacgauacaggucacgaaacugaugaaaacagagcgaaaguagaaauaacuccaaauaguccuagagccgaagcaacuuuaggcgguuuugguucauuaggauuagacugugaaccaagaacuggauuagauuucucugauuuauacuacuuaacuaugaauaauaaacauuggcuaguccauaaagaaugguuucaugacauaccauuacccuggcacgcaggugccgacacagguacaccacauuggaauaauaaagaagcauuaguugaauuuaaagaugcacaugcaaaaagacaaacaguaguaguauuagggagucaagaaggagcaguacauacagcuuuagcaggggcauuggaagcagaaauggauggcgcuaaagguagacuaucaucuggacacuuaaaaugucgacuaaaaauggauaaauuaagacuuaaaggaguaaguuauagccuaugcacggcagcguuuacauuuacaaaaauaccugcugaaacuuuacauggcacaguuacaguagaaguacaguaugcgggaacagauggucccuguaaaguaccagcucaaauggcuguagauaugcaaacguuaacaccaguaggcagauuaauaacagcaaacccaguuauaacagaaaguaccgaaaauagcaaaaugauguuggaauuagauccaccuuuuggagauucauauauaguaauaggaguuggagaaaaaaaaauaacacaucauuggcauagaaguggaucaaccauaggcaaagcuuuugaggcaacaguaaggggagcaaaacgaauggcaguauuaggagauacagcaugggauuuugguucaguaggaggagcacucaauagucuuggcaaaggcauacaucagauauuuggagccgcuuucaaaucauuauuuggugggaugucaugguucucacaaauucugauaggaacacuguuaaugugguuaggccuuaauacgaaaaauggaucaauuagcuuaaugugcuuagcauuaggaggaguacuaauuuuuuuaucaaccgcaguaagcgcugauguagggugcaguguagauuuuucaaaaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9237 - RNA, 2365 nt, Artificial Sequence
  KX827309.1 prME-long mRNA Design 3 opt
gggagaaagcuuaccaugagaauaauaaaugcacgaaaagagaagaaaagacggggcgcagacacaagugucggaauuguaggauuacuucuaacaacagcaauggcagcagaaguaacaagaagaggaagugcauauuauauguaucuggauagaagcgaugcaggagaagcaauuagcuucccaacaacguuagguaugaauaaaugcuacauacaaauaauggauuuaggacauaugugcgacgcaacaaugaguuacgaauguccaaugcuggaugaaggaguagaaccagacgauguggauuguuggugcaacacuacaaguacuugggugguauauggaacuugccaucacaagaaaggugaagcaagaagaucaaggagagcuguuacguuaccaucacacaguacaagaaaauuacaaacaagaagucaaacauggcuggaaaguagagaauacacaaaacacuuaauaagaguugaaaauuggaucuuuaggaacccaggauuugcacuagcugcagcagcaauagccuggcuacuagguaguaguacaagccaaaaaguaauauauuuagucaugauccuauuaauagcaccagcauacucuauaagauguauaggaguaagcaauagagauuucguagaaggaaugucuggaggaaccuggguagauguaguuuuagaacacggaggcugcguaacaguuauggcccaagauaaaccgacaguugauauagaacuuguaacaacaacgguaaguaauauggcagaaguaagauccuacuguuacgaagcaaguauaagugacauggcuucagauucaagauguccaacacaaggggaagcguaccuugauaaacaaucugauacacaauauguuuguaaaagaacccuaguagauagagguuggggaaauggauguggacuuuuuggaaaagggaguuuaguuacaugugcaaaauucgcauguaguaagaaaaugacagguaaaaguauacaaccagaaaauuuggaauacaggauaauguuaaguguccauggaagucaacauagcggaaugauagucaaugauacggggcaugaaacagacgaaaacagagcaaaaguagaaauaacaccuaauuccccgcgagcagaagcaacauuagguggauuuggcucauuaggauuagauugcgaaccaaggacuggauuagauuuuagugauuuguauuauuuaacaaugaacaauaaacauuggcuuguucauaaagaaugguuucaugauauuccacuaccauggcacgcaggagcugauacaggcaccccacauuggaauaauaaagaagcauuggucgaauuuaaagaugcucaugcaaaaagacaaacgguaguaguauuaggaucacaagaaggagcaguacauacagcacuugcuggugcuuuagaagcagaaauggauggagcaaaaggucgauuaaguaguggacauuuaaaauguagauuaaaaauggacaaauugagacuaaaaggugucuccuauagcuuaugcacagcagcauuuacauuuacaaaaaucccagcagaaacauuacauggaacuguaacuguugaaguacaauaugcagguacagauggcccguguaaaguuccagcucagauggcuguugauaugcaaacauuaacaccugucggaagauuaauaacggcaaaucccguaaucacggaaaguacugaaaauaguaaaaugaugcuagaauuagauccaccauuuggggacagcuauauaguaauaggaguaggugaaaagaaaaucacacaucauuggcauaggaguggaagcacaauaggaaaagccuuugaagcaacaguaagaggagcaaaacgaauggccgugcuaggugauacagcaugggauuucggaucaguggguggagcucucaauuccuuaggaaaagggauacaucaaauauuuggagcugcauuuaaaagucuauuuggggguaugucuugguuuagucaaauauuaauuggaacauuacuuauguggcugggauuaaacacuaaaaaugguucgauaaguuuaauguguuuagcauuaggugggguuuuaauuuuucuaaguacagcaguauccgccgauguggguuguaguguagauuuuucaaaaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9238 - RNA, 2365 nt, Artificial Sequence
  KU681081.3 prME-long mRNA Design 3 opt
gggagaaagcuuaccaugagaauaauaaaugcaagaaaagaaaagaaaagaagagguacagacaccaguguaggaauaguaggauuacuauugacaacagcaauggcugcagaaguuacacgcagaggaucugcuuacuauauguaccuagauagaagugaugcaggagaagccauuucauucccaacaacuuuagguaugaauaaauguuauauacaaauaauggaucuaggacacaugugcgacgcaacuaugaguuaugaaugcccuaugcuagaugaaggaguagaacccgaugauguugauuguugguguaacacaacaaguacauggguaguauacggaacaugucaucauaagaaaggcgaagcaagaagaagcagacgagcaguuacauuaccgagccauucaacaagaaaacuacaaacaagaucucaaaccugguuagaaagucgagaauauacaaaacauuuaauuagaguagaaaacuggauauucagaaauccaggauuugcuuuagcagcugcagcuauagcauggcuacuaggaucauccacaucacaaaaaguuauauacuuaguaaugauucuauuaauagccccagcauauucaauaagaugcauagguguaaguaauagagauuucgucgaaggaaugaguggaggaacauggguugacguaguacuagaacauggaggcuguguaacaguaauggcccaagauaaaccgacuguagauauagaauuaguaacaacaacaguaaguaauauggccgaagucagaucauacuguuaugaagccagcauaagugauauggcaagcgauuccagauguccaacucaaggugaggcauauuuagauaaacaaucggauacacaauaugugugcaaaagaacucuaguagacagaggauggggaaacggcuguggauuauuuggaaaaggaagucuaguaacaugugccaaauuugcaugcucaaagaaaaugacuggaaaaucaauacaaccagaaaaucuagaauaucgaauaauguuaagugugcauggaagucaacacagcggaaugauaguaaacgauacuggucaugagacagacgaaaacagagcaaaaguagaaauaacaccuaauucaccacgagcagaagcaaccuuaggaggcuucggaucccuaggauuagauugugaaccacgaacaggcuuagacuuuagugauuuauauuauuuaacaaugaauaacaaacauuggcugguacauaaagaaugguuucacgauaucccauuaccauggcacacaggugcagauacaggaacaccacauuggaacaacaaagaggcgcuuguagaauuuaaagaugcucacgcaaaaagacaaacaguuguaguauugggaucucaagaaggcgcaguacauacagcauuagcuggagcucuagaagcagaaauggacggugcaaaaggccgacugucuucuggucacuuaaaaugcagacucaaaauggauaaauuaagacuuaaaggcguaucauacaguuuauguaccgcugcuuucacauuuacaaaaauaccagcugaaacuuuacauggaaccguaacaguagaagugcaauacgcugguacugauggaccauguaaagugcccgcucaaauggcaguagauaugcagacacuaacaccagugggacgauuaauuacugcaaauccaguuauuacagaaggaacagaaaacucaaaaaugauguuagaauuagauccaccauuuggugauucauauauaguaauaggaguaggugagaaaaagauuacacaucauuggcauagaucaggaucaacaauagggaaagcguucgaagcuacaguaagaggagcuaaaagaauggcaguauuaggagacacggcaugggauuuuggaucaguggguggaguacucaauucauugggaaaaggaauacaccaaauauucggagcagccuucaaaagccuauuuggaggaaugaguugguuuagucaaauacucauaggaacauuguuaauguggcuaggcuuaaauacuaaaaauggcaguauaucacuaaugugucuugcacugggaggaguacuuauauuucuaucaacagcuguauccgcagauguaggauguagcguagauuuuagcaaaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9239 - RNA, 2365 nt, Artificial Sequence
  KU744693.1 prME-long mRNA Design 3 opt
gggagaaagcuuaccaugagaauuauaaaugcaaggaaagaaaaaaaaagaaggggagcugauacaucaguaggaauaguuggucuucuacuaacuacagcaauggcagcggaaguaacgcgaagaggaucagcauauuauauguaucuagauagaaaugaugcaggagaggcaaucucuuuuccuacaacauuaggaaugaacaaauguuacauacaaauaauggacuugggacauaugugcgaugcaaccaugucauaugaauguccuauguuggaugaagguguagaaccugaugacguugauuguuggugcaauacaacaucaacauggguaguauacgggacaugucaucacaaaaaaggugaagcuagaagaucaagaagagcuguuacauuaccuucacacucaacacgaaaauuacaaacaagaucacaaacaugguuagaaucaagagaauauacaaaacaccuaauaagaguagaaaauuggauauuuagaaauccagguuuugcauuagcagcagcagcaauagcaugguuauuaggauccucaacgagucaaaaaguuauuuauuuaguaaugauuuuguuaauugcuccagcuuauucaauaagaugcauagguguaaguaaucgagacuuuguagaagggaugaguggugggacauggguagauguaguauuagaacacggcggaugcguaacggcaauggcgcaagacaaaccaacaguagauauagaacuaguuacaacuacgguuucuaacauggcagaaguaagaucuuauugcuacgaagcaucaauaucagacauggcaucugauaguagauguccaacacaaggggaagcauaucuagauaaacaaucagauacacaauauguauguaaacgaacucuaguagaccguggcugggguaacggaugcgggcucuuuggaaaaggaucauuaguaacaugugcaaaauuugcuuguuccaagaaaaugacaggaaaaagcauacaaccagaaaaccuugaauauaggauaauguuaucaguacauggcucacaacauagugguaugcuuguaaaugauacaggacaugaaacggacgaaaaccgagcaaaaguugaaauaacuccaaauaguccgcgagcugaagcaacguuaggcggauuuggaagcuuagggcuagauugugaaccaagaacaggauuggauuucucagaucuuuauuauuuaacaaugaauaauaaacauugguuagcacacaaggaaugguuccaugauauaccccuaccauggcaugcaggugcagccacgggaacuccucauuggaacaauaaagaagcauuaguagaauuuaaagacgcacacgccaaaagacaaaccgucguuguacuuggaucacaagagggagcaguacauacagcauuagcaggagcauuggaagcagaaauggauggugcuaaaggaagauuaucuagcggacaucuaaaaugcaggcuaaaaauggacaaacuacgauuaaaagguguaagcuauagucuaugcacagcagcuuuuacauuuacaaaaauacccgcagagacuguugacgguacaguaacaguagaaggucaauauggagggacugaugguccuugcaaaguuccagcacaaauggcagucgacaugcaaacacuaacgccaguugguagacuaauaacagcgaaucccgucauuacagaaucaacagaaaauucuaaaaugauguuagaauuagauccaccauuuggcgauagcuauauaguuaucggaguaggcgaaaaaaaaauaacucaucauuggcaccggaguggaagcacuauaggaaaagcauucgaagccacaguaaggggugcaaaaagaauggcagugcuaggagauacugcaugggauuuuggaaguguagggggcgcauuaaauaguuuaggaaaaggaauacaucaaauaauaggugcagccuuuaaaagucuauucggaggaaugaguugguuuagccaaauauuaauaggaaccuuacugaugugguuaggacuuaacacgaaaaauggaagcauaucacuuaugugucucgccuugggaggaguauuaauauuucuaucgacggcaguaagcggcgggguagguuguucaguagauuuuucaaaaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9240 - RNA, 2365 nt, Artificial Sequence
  KY328290.1 prME-long mRNA Design 3 opt
gggagaaagcuuaccaugagaauaauaaacgcaagaaaagaaaaaaaaaggagagguacagauacauccgucggaauaguggguuuauuacuuacaacugcaauggcggcagaaguaacacgaagaggaagcgcauauuauauguauuuagaucgaagugaugcgggagaagcaauaagcuucccaacaacauuaggaaugaacaaauguuauauacaaauaauggauuuaggacacaugugugaugcaacgaugucauaugaauguccaauguuagaugaaggaguagaaccggaugaugucgauuguugguguaauacaacaucaacauggguaguauauggaaccugccaucauaaaaaaggugaagcaagaagaucuaggagagcaguaacgcuuccaagucauaguacaaggaaauuacaaacuagaagucaaacaugguuagaaaguagagaauacacuaaacauuuaauacgaguagaaaacuggauauuuagaaauccaggcuucgcauuagccgcagcugccauagcaugguuauuagguucgaguacgucacaaaaaguuauauauuuaguuaugauucuauuaauugcccccgcauauaguauaagaugcauaggagugaguaaccgggauuuuguugaaggaaugucaggaggaacaugggucgauguuguauuagaacaugguggaugcguaacaguuauggcacaagacaaaccaacaguggacauagaauuaguaacaacaacgguaaguaauauggcagaaguacgaaguuacuguuaugaagcaaguauaucagauauggcaagcgauucuagauguccaacucaaggcgaagcauaucuagauaaacaauccgauacacaauacgugugcaagaggacguugguagauagaggaugggguaaugggugcggguuauucggaaaagguucauuaguaaccugcgcuaaauucgcguguucuaaaaaaaugacaggaaaaucaauacaaccggaaaauuuagaguauagaauaauguugucaguucauggaagucaacauucaggaaugauaguaaaugauacuggacaugaaacagacgagaaccgagcaaaaguugaaauaacaccaaauaguccaagggcagaagcuacauuaggaggauuuggcucucuaggacuggauugugaaccaagaacuggcuuagauuuuagcgaccuauauuaccuaacgaugaauaauaagcacuggcuaguacacaaagaaugguuccacgauauaccauuaccauggcaugcaggugcagauacaggaacuccacauuggaauaauaaagaagcacuaguggaguuuaaagacgcacaugcaaaaaggcaaacaguuguaguuuuaggcagucaagaaggcgcuguacauacagcauuagcaggagcacuagaagcggaaauggauggagcaaaaggaagauuaucaagcggacaucuaaaauguagguuaaaaauggauaagcuuagauuaaaaggagucaguuacucauuauguacggcagcuuuuaccuuuagcaaaauaccagcagaaacacuacacggcacaguuacugaagaagugcaauaugcuggaacugauggcccaugcaaaguaccggcacaaauggcaguagauaugcaaacacuaacaccaguaggaagauuaauaacagcaaacccaguaauaacagaaucaacagaaaacaguaaaaugauguuagaauuagacccaccauuuggagauucauauauagucauaggaguaggagaaaaaaaaauuacccaucauuggcauagaagugguaguacaauaggcaaagcauucgaagcuacaguaagaggagcaaaaaggauggcagucuuaggagacacagcaugggauuuuggaucaguaggaggagcuuuaaauaguuuaggaaaaggaauucaucagauauucggagcagcauuuaaaagccuauucgguggaaugagcugguuuucgcaaauauugauaggaacauuacuaaugugguuaggauuaaacacaaaaaacggaucuauaagucugaugugccuagcguuagggggcguucuaauauuccucucaacagcaguaucagcggacguaggauguucaguagauuucucaaaaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9241 - RNA, 2365 nt, Artificial Sequence
  KX694532.2 prME-long mRNA Design 3 opt
gggagaaagcuuaccaugagaauaauaaaugcacgaaaagaaaaaaaaagaagaggaacagacacuucaguaggcauuguaggacuacuacuuacaacagcaauggcagcagagguaacacgaaggggaagugcauauuauauguauuuagacagaucagaugcaggagaagcgaucucauuuccuacaacauugggaaugaauaaauguuacauccaaauaauggaucugggccauaugugugaugcaacaaugaguuacgaauguccaauguuagaugaaggggucgagccagaugauguagauuguugguguaauaccacuucaacauggguuguuuauggaacaugccaucauaaaaaaggagaagcaagaagauccagaagggcaguaacauuaccaucacauucuacacgaaaauuacaaacccgaucgcaaacauggcuagaaaguagagaauacaccaaacauuuaauaagagucgaaaauuggauauucagaaacccaggcuuugcuuuagcagcagcugcgauagccuggcuacuaggaaguagcacuucacaaaaagucaucuauuuaguaaugauuuuacuaaucgcuccagcauacagcauuagauguauuggaguuaguaauagagacuuuguagaaggaaugucaggcggaacauggguugaugugguccuagaacauggcggauguguaacaguaauggcccaagauaaacccacaguagauauagaauuaguaacgacaacagugagcaauauggcagaaguaagaucauauugcuacgaagcuucaauaucugauauggcaagcgauucgagaugcccaacacaaggagaagcauaucucgauaaacaaagcgacacucaauauguaugcaaaagaacacuaguagacagaggcugggguaaugguugugguuuguuuggaaaagggaguuuaguaacaugugcuaaauucgcaugcucgaagaaaaugacaggcaaaucaauacaaccugaaaauuuagaauacagaauaaugcuaaguguacaugguucacaacauucagguaugauuguaaaugauacaggucacgaaacagaugaaaauagagcuaaaguagaaauaacccccaauucaccaagagcugaagccacacuaggaggcuucgguaguuuaggguuagauugugaaccuagaacagggcuugauuuuucagaccuuuauuaucucacaaugaauaauaaacacuggcucguacauaaagaaugguuccaugacauaccucuacccuggcacgcuggagcagauacaggaacgccacacuggaauaauaaagaagcuuuaguagaauucaaagaugcccacgccaaaagacaaacuguaguaguacuaggaagucaagaaggagcaguacacacagcuuuagcaggagcauuagaagcggaaauggacggagcgaaaggaagauuaucaucuggucauuuaaaauguagauugaaaauggauaaacuaagauuaaaagguguuucauauagcuuaugcacagcugcauuuacauuuacaaaaauaccagcagaaacuuuacauggcacaguaacaguagaaguccaguaugcagguacugauggaccuuguaagguacccgcacaaauggcaguagauaugcaaacacucacaccaguaggaagacuaauuacagcuaauccaguuauuacagaaagcacagaaaauuccaaaaugaugcuagaguuagauccaccuuuuggugacaguuauauagugauaggggucggagaaaaaaaaauaacacaucacuggcauagaagcggaucaacaauaggaaaagcauuugaagccacaguaagaggagcuaaaagaauggcuguacuaggcgauacagcaugggauuucggaaguguuggcggagcucugaacagccucgggaaagguauacaucaaauauuuggugcggcauuuaaaaguuuauuuggaggaaugucaugguuuucacaaauauuaauaggaacacuacuaaugugguuaggucucaauacuaaaaauggaaguauaagcuuaauguguuuagcauugggaggagucuuaauauuccuaucaacagcaguaagugcagauguaggauguaguguugauuuuuccaaaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9242 - RNA, 2365 nt, Artificial Sequence
  KU955593.1 prME-long mRNA Design 3 opt
gggagaaagcuuaccaugagaaucauuaaugcacguaaagaaaagaaaagaaggggaacagauacgucuguaggaauaguuggacuacuauuaacaacugcaauggcuguagaaguaacaagaagaggaaaugccuauuauauguauuuagauaggucggacgcaggagaagcaauuucauucccaacaacaaugggaaugaacaaauguuauauccaaaucauggaccuuggacauaugugugacgcaacaaugucauaugaauguccaauguuagaugaagggguugaaccagaugauguagauuguuggugcaacacaacaagcacauggguagucuacggaacaugucaucauaagaaaggagaagcacgaagaucaagacgagcaguuacauuaccaagucacucaacaagaaaauuacaaacaagaucacaaacauggcucgaaaguagagaauacaccaaacaucugauccgaguagaaaacuggauauuuagaaaucccgguuuugcucuugcugccgccgcaaucgcaugguuacuaggaucgucuacuucacaaaaaguuauauauuuaguaaugauauuauugauagcuccagcauauuccauuagaugcauaggaguuuccaauagagauuuuguagaagggaugagcggagguaccuggguagauguaguauuagaacacggaggaugcguuacaguaauggcacaagacaaaccaacaguagacauagaauuaguuacaacaacaguaucaaacauggcagaaguucguuccuauugcuacgaagcaaguauuucagauauggcaagugauaguagauguccgacacaaggagaagcauauuuagacaaacaaucagacacucaauauguauguaaaagaacucuaguagauagagguuggggaaauggcuguggauuauucggcaaaggaucucuaguaacaugugcaaaauuugccuguaguaagaaaaugacaggaaaauccauccaaccagaaaauuuagaauaucgaauaauguuaucaguacauggaucacaacauuccggaaugaucgucaacgauacuggucaugagacugaugaaaauagagcaaaaguagaaauaacaccaaauucaccucgagcugaagcaacauugggaggauuuggaucacuaggacuagacugugaaccaagaacaggacuugauuuuagcgacuuauauuaccuuacgaugaacaauaaacauugguuaguacauaaagaaugguuucacgacauaccacuaccuuggcaugcaggagcagauacgggaacuccccauuggaacaauaaagaggcuuuaguagaguucaaagacgcacacgcaaaaagacaaacaguaguaguucuuggaagucaagaaggagcuguacacacagccuuagcuggugcacuagaagcagaaauggauggagcaaaaggaagauuaaguaguggacacuuaaaauguagauuaaaaauggauaaauuacgauuaaaaggaguuucauauucauuaugcacagcagcuuuuacguucacgaagauaccagcagaaacacugcacggaacaguaacaguagaaguacaauaugccgguacagauggaccuuguaagguaccagcacaaauggcuguugacaugcaaacauuaacucccguugguagacuaauaacagcaaauccaguaauaacugaaagcacagaaaauucuaaaaugaugcuagaauuagauccaccuuuuggagauagcuacaucguaauaggaguuggcgaaaagaaaauaacucaucacuggcaccguucagggucaaccauugguaaagcauuugaagcaacaguaagaggagccaaaagaauggcgguacuaggagauacggcaugggauuuuggaaguguaggaggugcccuaaauuccuuggguaaaggaauacaccaaaucuuuggagccgcauuuaaaucauuauucgggggaaugaguugguucagccaaauauuaauuggaacacuauuaguaugguuaggauugaauacuaaaaauggaucuauaucacuaaugugccuagcauuaggaggagugcucauauuccuaaguacugcuguuucagcagauguaggauguaguguagauuucagcaaaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9243 - RNA, 2365 nt, Artificial Sequence
  KY272987.1 prME-long mRNA Design 3 opt
gggagaaagcuuaccaugagaauaauaaaugcaagaaaagaaaaaaaacgaagaggaacagauacaagcguggguauaguuggcuugcuauugacuacugcaauggcagcugaaguaaccagaagaggaagugcauacuacauguaucuagaucguucugaugccggugaagcaaucucauuuccuacaacauuagguaugaacaaauguuauauacaaauaauggaucuaggucauaugugugaugcaacaaugucuuaugaauguccuaugcuggacgagggaguugaaccagaugacgucgauugcuggugcaauaccacguccacauggguaguuuauggaacuugucaccacaaaaaaggagaagcaagaagaaguagaagagcaguaacgcuaccaagucauaguacaagaaaacuccaaacaaggucacagacuuggcucgaaaguagggaauauacuaaacaucuaauacgaguagaaaauuggauauuuagaaauccaggguuugcguuagcagcagcagcaauagcuugguuauuaggcuccaguacuucacaaaaaguaaucuacuuaguaaugauauuauuaauagccccagcauauucaauaagauguauagguguuaguaauagagauuuuguagaaggaaugucaggagguacuuggguagaugucguucuagaacacggaggaugcguaacaguaauggcacaagauaaacccacuguagauauagaacuaguuacaacaacuguauccaauauggcagaaguaagaaguuauuguuacgaagcuagcauaagcgauauggcaagugacucaagaugucccacacaaggugaagcauaccuugauaaacaaucagauacucaauauguaugcaaacguacacugguagaccguggaugggggaauggaugcggacuauucgguaaaggauccuuaguuacaugugcaaaauuugcuuguucaaaaaaaaugacugggaaaucaauacaaccagaaaacuuagaauauagaauuauguuaucgguacacggaucacagcauucuggaaugauaguaaaugauacaggacaugaaacagaugaaaaucgagcuaaaguagaaauaacuccuaauaguccaagagcggaagcaacucuaggagguuuuggaagucuaggauuagauugcgaaccgagaacuggguuagacuuuucagauuuauauuaucuaacuaugaacaacaagcacugguuaguacauaaagagugguuucaugauauaccgcuaccauggcaugcgggagcugauacaggaacuccacauuggaauaauaaagaagcacuaguggaauuuaaagaugcacaugcaaaacgacaaaccgugguaguacuaggaucacaagaaggagcaguacauacagccuuagcuggugcauuagaagcagaaauggauggagcaaaaggaagauuaaguaguggucaucuaaaauguagacuaaagauggacaaauuaagauuaaagggagugucuuacagucuauguacagcagccuuuacauuuacaaaaauaccugcugaaacauuacacggaacaguaacuguggaaguacaauaugcagguaccgauggaccauguaaaguuccugcacaaauggcuguagauaugcaaacucucacaccgguaggacgacuaauaacagcaaauccaguaaucacagaaaguacugaaaauaguaaaaugaugcucgaguuagauccacccuuuggcgacagcuauauaguaaucggaguaggugaaaaaaaaauuacacaccacuggcacaggaguggaagcacaauaggaaaagcuuucgaagcaacaguuagaggugcaaaaagaauggcuguacugggagauacagcaugggacuuuggaaguguaggaggagcacuaaauagcuuaggaaaaggaauacaccaaauauuuggagcagcauuuaaaucacuauuuggagguaugaguugguuuucgcaaauuuuaauaggaacauuauuaaugugguuagggcuaaauacaaaaaauggaaguauaucauuaguuugucuagcgcucggaggaguacuuauauuuuuaagcacagcaguaucagcagacguuggauguaguguggauuuuagcaaaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9244 - RNA, 2365 nt, Artificial Sequence
  EU545988.1 prME-long mRNA Design 3 opt
gggagaaagcuuaccaugagaauaauaaaugcaagaaaagaaaaaaaaagaagaggaacagacacaaguguuggaauuguugguuuacuacuuacgacagcuauggcaguagagguuacaaggagagguagugcauauuauauguaccuagauagaucagaugcaggagaagccauaucauuuccgaccacuuuaggaaugaauaaauguuauauacaaauaauggaucuaggacauaugugugaugcaacaaugaguuacgaaugcccaauguuagaugaaggaguagaaccugaugauguagauugcugguguaacacuaccucaacauggguuguauacggaacaugucaucauaaaaaaggugaagcuagacgaagcagacgagcuguaacguuaccaagucauucaacacgaaaacuacaaacuagaucacagacauggcuugaaucaagagaauauacaaaacacuuaauuagaguugaaaauuggauauuuagaaauccaggauuugcacucgcagcagcagcaauugcauggcuccuuggcaguaguacaucacaaaaaguaauauauuuaguuaugauauuauuaauagcuccagcauacaguauucgaugcauaggaguuucaaacagagacuuuguagaaggaaugucaggaggcacauggguagacguaguacuagaacacggcggauguguuacaguuauggcccaagauaaaccagccguagauauugaauuaguuacuacgacaguaaguaauauggcagaagugagaucauauuguuaugaagcaaguauaucagauauggcgucagauagccguugccccacccaaggcgaagcuuaucuagacaaacaaagugacacacaguacguauguaaaagaacauuaguagacaggggauggggaaauggaugcggacuauuuggcaaaggaagcuuaguaacaugcgcaaaauucgcuuguagcaaaaaaaugacaggaaaaucaauacaaccagaaaacuuagaauauagaauuauguugucaguacacgggagucaacauuccggaaugauaguaaaugacacuggucacgaaacagacgaaaauagagcaaaaguagaaauaacgccaaauucuccuagagcagaagcaacacuaggaggauuugggucuuuaggguuagacugugagccaagaacaggauuagauuuuucugauuuauauuauuuaacaaugaauaacaaacauugguuaguacauaaagagugguuccaugacauaccucuaccauggcaugcaggagcagauacuggaacuccacacuggaauaacaaagaagcacuuguugaauuuaaagacgcucaugcaaaaagacaaaccguaguuguauuaggaucacaagaaggugcggugcacacagcuuuagcaggggcccuagaagccgagauggauggugcaaaagguagacuuagcucuggucaccuuaaaugccgacuaaaaauggauaaauuaagacuaaagggaguaaguuauagccuauguaccgcagcguuuacauuuacaaaaauaccagcagaaacacuacauggaaccgugacaguagaaguucaauacgcaggaacagaugguccauguaaaguaccagcacaaauggcaguagauaugcaaacauuaacaccagugggaagauuaauaacagcaaacccaguaauaacagaaaguacagaaaauucaaaaaugauguuagaauuagaccccccuuuuggagauagcuauauagucauagguguuggcgaaaaaaaaauaacacaucauuggcauagaagcgguucaacaauaggaaaggcauuugaagcaacgguacgaggugcgaaaaggauggcuguauuaggagauacggcaugggauuuuggaucaguaggaggagcguuaaauucauuaggcaaaggaauacaucaaauauucggagcugcguuuaaaucauuauuuggugguaugucaugguucagucaaauauuaauaggaacacuuuuagucuggcuagguuuaaacaccaaaaaugguagcauaucauuaacaugcuuagcauuaggaggaguauuaauauuccucagcacagcgguuucagcagacguaggauguaguguagauuuuaguaaaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9245 - RNA, 2365 nt, Artificial Sequence
  KU681082.3 prME-long mRNA Design 3 opt
gggagaaagcuuaccaugagaauaauaaaugccagaaaagaaaaaaaaagaagaggagcggacacuucaguagguauaguaggacuauuauuaacaacagcgauggccguagaaguaacaagaagaggaagugcauauuauauguacuuagauagaagcgacgcaggagaagcgaucaguuucccaacaacauuagguaugaauaaauguuauauacaaauaauggaucuuggacauaugugugacgcaacuaugucauacgaauguccaaugcuagacgaaggaguagaaccugaugacgucgauuguugguguaauacaacuagcacauggguaguauauggaacaugucaucauaaaaagggugaagcuagaagaaguagaagagcaguaacgcuuccaucacacaguacaagaaaauuacaaacuagaagucaaacauggcuagaaucuagagaauauacuaaacaucucauacgaguagaaaacuggauauuucguaauccgggauuugcauuggcugcggcuguaauagccugguuauuaggaaguaguacaagucaaaaagugauauauuuaguaaugauacuacuuauugcuccagcuuacaguauaagaugcaucggaguaucaaauagagauuucgucgaaggaaugaguggagggacauggguagacguaguacuagaacauggaggcugcguaaccguaauggcacaagauaaaccaacaguagauauagaauuaguaacaacgacaguuuccaauauggcugaaguacgaucauacuguuaugaagccagcauuagugacauggcaucugauucuaggugucccacucaaggugaggcauaucuagacaaacaaucagauacacaauauguauguaaaagaacauuaguagauagaggaugggggaauggaugugggcuauuuggaaaaggaucguuagucacaugcgcgaaauuugcuuguucaaaaaaaaugacaggcaaaucaauucaaccugagaauuuagaauauagaaucauguuaucaguucauggaucacaacacagcggaaugauaguaaaugauacgggacaugaaacugacgaaaauagagcaaaaguugaaauaacuccaaauuccccuagagcagaagcaacacuagguggauuuggaucauuaggacuagauugcgaaccaagaacaggauuagauuuuagcgaucuauacuauuuaacaaugaauaacaaacauugguuaguacauaaagaaugguuucaugauauaccauuaccauggcaugcaggggcagacacugguacaccgcauuggaauaauaaagaagccuuaguagaauuuaaagacgcacaugcaaaaagacaaacaguugucguauuagguucucaagaaggagcaguacauacggcuuuagcaggagcucucgaagcugagauggacggagcaaaaggcagacuuucaaguggacaucucaaauguagguuaaagauggauaaacuucgauuaaaaggaguaaguuacucccuauguacugcagcauuuacuuuuacaaaaauaccagcugaaacuuugcauggaacaguaacaguagaaguacaauacgcaggaacggacggaccaugcaaaguuccagcacaaauggcaguagauaugcaaacacugacgccaguaggaagguuaauuacagcgaacccaguaauuacagaaucuaccgaaaauucaaaaaugauguuagaauuagaccccccuuuuggagacucuuacauaguuaucggaguaggugaaaaaaaaauaacacaccauuggcaucguagugguuccacaauaggaaaagcuuucgaagcaacuguaaggggagcaaaaagaauggcaguuuuaggagacacggcaugggacuucggaaguguaggaggggcacugaauucucuaggaaaaggcauacaucaaauauuuggugccgcauuuaaaucauuauuuggaggcaugaguugguuuucucaaauauuaauugguacauuauuaguauggcuaggauugaauaccaaaaacggauccauaucacuaacaugucuagcacuuggaggaguucuaaucuuucuaucaacagcuguaucagcagauguaggcuguucuguagauuuuagcaaaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9246 - RNA, 2365 nt, Artificial Sequence
  KX601167.1 prME-long mRNA Design 3 opt
gggagaaagcuuaccaugagaauuauuaaugcaagaaaagagaaaaaaagaagaggagcagauacaaguguuggaauaguaggauuacuacuaacaacagcaauggcaguggaaguaacacgcagaggaucugcauauuauauguaucuagauagaagugaugcuggagaagcaauaaguuuuccgacaacucuaggaguaaacaaauguuauauucaaauaauggaucuaggacacaugugcgaugcaacuaugucauacgaguguccuauguuagaugaaggugucgaaccugaugauguagacuguugguguaauacaacauccacguggguagucuauggcacaugucaucauaaaaaaggagaagcuagacgaucaagaagagcaguuacucuaccaagccacucgacaagaaaacuacaaacaagaucacaaacauggcuugaaucaagagaauauacaaaacaucuaauaagagucgaaaauuggauauucagaaauccaggauuugcauuagcagccgcagcaauagcaugguuauuaggcucaaguacaagccaaaaaguaauauaucuaguaaugauacucuuaauagcaccagcauacucuauaagaugcauugguguuaguaacagagacuuugucgaaggaaugucgggaggaacuuggguagauguaguacuagaacaugguggauguguaacaguaauggcacaagauaaaccaacaguagauauagaauuaguuacaacaacgguaucaaauauggcagaaguuagaagcuacuguuaugaagcaaguauuucagacauggcaucagacucaagauguccuacacaaggagaagcauaucuugauaaacaaagcgauacacaguacguauguaaaagaacacuaguugauagaggaugggguaauggauguggucuauuuggaaaaggaaguuuaguaacuugugcaaaauuugcauguucuaaaaaaaugacaggaaaaucaauucaaccugaaaacuuagaauauagaauaauguuaucuguacauggaucccaacauucaggaaugauuguaaaugauacaggucaugaaacagaugaaaauagagcuaaaguagaaaucacuccgaacucaccacgagcagaagcuacuuuaggaggauucgggucauuaggccuugauugcgaaccaaggaccggacuagauuuuucagauuuauacuacuuaacuaugaauaauaaacacugguuaguacacaaggaaugguuucaugacauacccuuaccauggcaugcaggagccgacacaggaacuccacauuggaauaauaaagaagcacuaguagaauucaaagaugcucaugccaaaagacaaacaguaguaguuuuaggaagccaagaaggcgcuguccauacagccuuagcaggagcacucgaagcagaaauggauggagccaaaggaagacuaucaucaggucauuuaaaaugucgucuuaaaauggauaaauuaagacuuaaagguguuaguuauagcuuauguacagcggcauuuaccuuuacaaaaauaccugccgaaacacuucacggaacaguuacaguugaaguacaauaugcagggacagacggaccaugcaaaguuccugcacaaauggcaguugauaugcaaacauuaacaccaguaggcagauuaauaacagcaaacccaguuauaacugaaucaaccgaaaacaguaaaaugauguuagaauuagauccaccuuuuggcgacaguuauauaguaauaggaguaggugacaaaaaaauaacucaucacugguacagaaguggaucaacuauagggaaagcauuugaagcaacaguaagaggggcaaaaagaauggccguauugggagauacggcaugggacuuuggcucaguaggcggugcuuugaauaguuuaggaaaagguauacaucaaauauuuggagcagcauuuaaaucauuguuuggaggaaugaguugguuuucucaaauuuugauugguacauuauuagugugguuaggacuaaauaccaaaaacggaaguaucagccuaacuugcuuagcccuaggggggguacuaauauuuuuaaguacagcagugagugcggacguaggaugcagugucgacuuuucaaaaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9247 - RNA, 2365 nt, Artificial Sequence
  KX694533.2 prME-long mRNA Design 3 opt
gggagaaagcuuaccaugaggauaaucaaugcaagaaaagaaaaaaaaagaagaggugcugacacauccgucggaauaguaggacuguuacuaaccaccgcgauggcuguagaaguaacacgacgcggcagcgcauauuauauguacuuagauagaagugaugcagguaaagcaaucuccuuuccaacaacauuaggaguaaauaaauguuacauacaaauaauggauuuaggacauaugugugaugcaacaaugucauaugaauguccuaugcuggaugaaggaguagaaccugaugacguugauuguuggugcaauaccacuucaacaugggucguauauggaacaugucaucauaaaaaaggagaagcuagaagaagcagaagagcgguuacucuuccaagucauaguacuagaaaacuacaaacaagaucucaaacuuggcuugaaucaagggaauacaccaaacauuuaauaagaguagaaaauuggaucuucagaaauccaggauucgcacuagcagcagcggcaauagcauggcuacuugguucaucuacaagccaaaaaguaauauauuuagucaugauacuauuaauagcacccgcauauucuaucagaugcauaggaguaaguaauagagauuuuguagagggaauguccggaggaacauggguagauguaguccucgaacaugguggauguguuacagugauggcacaagacaagccaacaguagauauagaauuaguuacgacaacugucucaaauauggcagaaguaagaagcuauuguuaugaagcaagcauaucugauauggcaagcgauucaagauguccuacucaaggagaagcguauuuagauaaacagucagacacacaguacguauguaaacgaacacuaguagacagaggauggggaaacggauguggauuauucggaaaagguaguuuaguaaccugugcaaaauuugcguguucaaaaaaaaugacuggaaaaaguauacaaccagaaaauuuagaauauaggauaaugcucagcgugcauggaucacaacauucaggaaugauaguaaacgauauaggacaugaaacagacgaaaaucgagcaaaagucgagauaacacccaauucaccacgagcagaggcuacccuuggagguuucggaucauuaggauuggauugcgaaccacgaacaggacucgauuuuagugauuuauauuaucuuacaaugaacaacaaacauugguuaguacauaaagaaugguuucaugacauuccacuaccauggcaugcaggagcagauacugguacaccacacuggaacaauaaagaagcacuaguagaauuuaaagaugcucacgcuaaaagacaaacaguagugguauuaggaagucaagaaggagcaguacauacagcacuagcaggagcccuggaagccgaaauggauggagcaaaaggaaggcuaucaucaggccaucuaaaaugcagacuaaaaauggauaaauugagauuaaaaggaguaucguauagcuuaugcacagcagcguuuacuuuuacaaaaauaccagcugaaacacuacacggaaccguaacuguagagguacaauacgcaggaacagaugguccauguaaagucccagcacaaauggcaguagauaugcaaacauuaacacccguaggaaggcuuauaacugcaaauccaguuauaacagaaaguacagaaaauucuaaaaugaugcuggaauuagauccacccuucggagauucauacauaguaauaggaguaggagauaaaaaaauuacacaucauuggcauagaucugggaguacaauugguaaagccuuugaagcaacagugcgaggcgcaaaaagaauggcaguauuaggagauacagcuugggauuuuggaucagugggaggagcauuaaauaguuuaggaaaaggaauacaucaaauauucggagcagcauuuaaaagucuauuuggaggcaugucaugguuuucacaaauucuuauaggaacgcuuuuaguaugguuaggauuaaauacaaaaaauggaucaauaucacugacauguuuagcgcuagguggcguuuuaauauuuuuaagcacggcaguaucagcagacguaggaugcucaguagauuuuuccaaaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9248 - RNA, 2365 nt, Artificial Sequence
  KY288905.1 prME-long mRNA Design 3 opt
gggagaaagcuuaccaugagaauaauaaaugcaagaaaagaaagaaaaagaagaggagcagauacaagcauagguauaguagggcuauuauuaacaacugcuauggcagcagaaaucacgagaagaggaagugcauauuacauguauuuggacagaucugaugcaggaaaagcaauaucuuucgcaacaacuuuaggcguaaacaaaugucauguucaaauaauggacuuaggccacaugugugaugcgacaaugaguuaugaauguccaauguuagaugaaggaguagagccagaugauguugauuguuggugcaauacaacaagcacaugggucguuuacgggacuugucaucauaagaaaggagaagcaagaagaaguagacgagcuguuacuuuaccaagccauaguacaagaaaauugcagacaagaagccaaacauggcucgaaagcagagaauauacaaaacauuuaauaaaaguagaaaauuggauauuccgaaacccaggauuuacgcugguagcaguagccauagcuugguuguuaggauccuccacgucacaaaaagugauauacuuagugaugauauuacuaauugcaccagcuuauucaauaagguguauaggaguaucaaauagagauuuuguagaaggaaugaguggaggaacuuggguagacguaguacuagaacauggagguugugugacuguaauggcacaagauaaaccgacuguugauauagaacuuguaacaacaacuguaucaaauauggcugaaguaagaucauacugcuaugaagcaucuauaagugauauggccuccgauucaaggugcccaacacaaggggaggcuuacuuagauaaacaaagugauacacaauauguauguaaacgaacauuaguagauagaggaugggguaaugguugcggauuauuuggaaaaggaaguuugguaacaugugcuaaauuuacuugcaguaagaaaaugacaggcaaaagcauacaaccggaaaaucuggaauauagaauaauguuaucaguacauggaucacaacauaguggaaugauaguaaaugacacugggcaugaaacagaugaaaauagagcaaaaguagaaguuacaccgaacagcccaagagcggaagcaacuuuagguggguucggaucccuaggacuagacugugaaccaagaacaggcuuggauuuuagugacuuauauuaccuaacaaugaacaauaaacauuggcuaguucauaaagaaugguuucacgauauaccauuaccauggcacgcaggagcagauacaggaacaccacauuggaauaauaaagaagcgcuagucgaguucaaagaugcacacgcaaaacgacaaacaguagucguacuugguucacaagaaggagcaguucacacugcuuuagcgggugcauuagaagcagaaauggauggagcaaaaggaagacuauuuucaggacaucuuaaaugccgucuuaaaauggauaaauuaagacuuaaaggaguaaguuauucacuaugcacagcagcauucacauuuacuaaaguuccugcagaaacauuacacggaacagugacaguugaaguccaauacgcuggaacagaugguccauguaaggucccagcacaaauggcgguagauaugcaaacauugacaccaguuggaagacuaauuacagcaaauccaguaauaacagaaaguacagaaaauaguaaaaugauguuagaauuggacccacccuuuggagauaguuauauaguuauaggaguaggagauaagaaaauaacacaucacuggcauagaucuggaucaacgauaggaaaagcauuugaagcaacuguaagaggagcuaaaagaauggcaguacuuggagauacagcaugggacuucggcucaguaggcggugucuucaauucauuaggaaaaggaauacaucaaauauuuggcgcagcauuuaaaucacuauucggagguaugaguugguuuucacaaauacuuauaggaacccuuuuaguuuggcuaggacuaaauacuaaaaaugguucaaucaguuuaacauguuuggcauuaggaggaguuaugaucuuucuaagcacagcuguuagugcugauguaggguguagcguagauuuuucaaaaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9249 - RNA, 2365 nt, Artificial Sequence
  KF268950.1 prME-long mRNA Design 3 opt
gggagaaagcuuaccaugagaauuauaaaugcaagaaaagagagaaagagacgaggagccgacacaucuauaggaauaauaggacuacuauuaacaaccgcaauggcagcagaaauaacucgaagagggagugcauacuacauguauuuagaucgaucagacgcugguaaagccauaaguuuugcgacuaauuuaggaguaaacaaaugccauguucaaauuauggaccuaggacauaugugcgaugcaacaaugaguuacgaauguccaaugcuagaugaaggaguagaaccagacgauguagauugcugguguaauacaacaucaacauggguuguauacggaacaugucaucauaaaaaaggagaagcaagacgaucaagaagagcaguaacuuugcccucucacagcacaagaaaauuacagacccgaagccaaaccuggcuagaaucaagagaauauacaaaacaucuuauaaaaguugaaaauuggauauuuagaaaucccgguuuugcguuagcagcaguagcuauagccugguuacuuggaagcaguacaucacaaaaaguuauauauuuaguuaugauauuauuaauugcgccagcuuauucaauuagauguaucggaguaagcaaccgggauuucguugagggaaugucaggggguacauggguagauguaguauuagaacaugggggaugcguaacaguaauggcgcaagauaaaccaacaguagacauagaauuaguaacaacgaccgugucaaacauggcagaaguucgcucauauuguuaugaagcaaguauaucugauauggcaucagacucaagauguccuacacaaggugaagcauacuuagacaaacaaucugauacucaguacgucuguaaacgaacucuaguagacagaggauggggaaauggaugcggucuauuugguaaaggaucacuagugacuugugcaaaauuuacauguagcaaaaaaaugacagguaaaaguauucagcccgaaaaccuugaguauagaauaauguuaucaguccauggaucucaacauagugguaugauagucaaugauauaggccaugaaacagaugaaaauagagcaaaaguugaaguaacaccaaauucaccaagagcagaagcaacccuagggggauuuggaucacuuggauuagauugugaaccuagaacuggacuagacuuuucagacuuauacuauuuaacaaugaacaauaaacauugguugguacauaaagaaugguuucacgauaucccuuuacccuggcaugccggagccgauacaggaaccccacauuggaauaauaaagaggcacuaguugaauuuaaggaugcacaugcgaaaagacaaacaguaguaguacuaggaucacaagagggagccguacauacggccuuagcuggagcacuagaagcagaaauggacggagcuaaaggaagacuauuuagcgggcacuugaaaugccgauuaaaaauggauaaauuacgacuuaaaggaguuuccuacucauuaugcacagcugcauuuacguuuacuaaaguaccugcagaaacauugcacggaacaguaacaguagaaguacaauaugcugguacagauggacccuguaaagugccagcgcaaauggcuguggauaugcaaacauuaacuccuguuggaagacuaauaacagcaaauccaguaauaacagaaucaacugaaaacaguaaaaugauguuagaauuagacccuccauuuggggauucguauauaguaauagguguuggagauaaaaaaauaacacaucauuggcauagaagugggucgacaauaggaaaagcuuucgaagcaacaguaagaggagcaaaaagaauggcagucuuaggagacacagcaugggauuuuggaucaguuggaggugucuucaauaguuuagguaaaggaguacaccaaaucuucggagcagcuuucaaaagucuauuugggggaaugucaugguuuucacaaauacuuauuggaacauuacuagucugguuaggacucaauacaaaaaauggcaguauaagcuuaacauguuuggcauuaggaggcgugaugauuuuccuaagcacagcaguaucagcagacguagguuguaguguugauuucaguaaaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9250 - RNA, 2365 nt, Artificial Sequence
  KF383121.1 prME-long mRNA Design 3 opt
gggagaaagcuuaccaugcgaauaauaaacgcaagaaaagaacgaaaaagaagaggagcagacacaucaauuggaauaauaggucuguuauuaacaacagccauggccgcagaaauuacaagaagaggcagugcauauuauauguauuuagaccgaagugaugcuggaaaagcaauaucauucgcuacuacauugggagucaauaaaugucauguccaaauuauggaccuuggucauaugugcgacgcaacuaugucauaugaauguccgauguuagaugaggguguugaaccagacgacguagauuguuggugcaacacaacaaguacuuggguaguauauggaacaugccaucauaaaaaaggagaggcacgccgaaguagaagagcaguaacacuaccaucucacucaacaagaaaauuacaaacuaggucacaaacaugguuagagucacgcgaauacacaaaacauuuaauaaaaguagaaaauuggauauuuagaaauccaggauuugcacuuguagccguagccauagcuuggcuacuugguagcucaacaagucaaaaaguaauauauuuaguaaugauauuacuaauagccccagcauacaguauaaggugcauagguguaucaaauagagauuuuguagaagguaugucaggcggaacauggguagauguaguacuugaacacggaggaugcguaacaguaauggcgcaagacaaacccacaguagacauugaacuaguaacaaccacaguaagcaauauggcugaaguaagaucuuauuguuacgaagcaaguauaagcgauauggcaagugauucaagauguccuacacaaggcgaagcauauuuggauaagcaaagugacacucaauauguuuguaaaagaacuuuagucgacagaggauggggaaauggaugcggacuuuuuggaaaaggaagccuaguaacaugcgccaaauucacauguaguaaaaaaaugacaggaaaaaguauacaaccugaaaaccuagaguacagaauaaugcuuaguguacacggaagccaacacuccggaaugauuguaaaugauauuggucaugaaacagacgaaaauagagcaaaaguagaaguuaccccaaacucaccuagagcagaggcaacacuagguggauuuggcucauuaggauuagauugugaacccagaacagggcuagacuuuagugacuuauauuaucuaacgaugaacaauaaacauugguuaguccauaaagagugguuccaugauauaccccuaccauggcaugcgggagcagauacugguacaccacauuggaacaacaaagaagcauuaguagaauuuaaagacgcucaugcuaaaagacaaacuguaguaguauuaggaucacaagaaggugcagugcacacagcauuagcaggugcucuagaagcagaaauggauggagcaaaaggaagauuauucucagggcaucuaaaaugccgauuaaaaauggauaaauuaagauuaaaagggguaaguuauucauuauguacagcagcauucacuuuuacuaaaguaccagcagaaacauuacacgguacagucacaguagaaguacaauaugcaggaacagauggaccaugcaaaguaccagcacagauggcaguagauaugcaaacauuaacaccaguuggacguuuaauaacagcgaauccaguaauaacagaaucaacagaaaauaguaaaaugaugcuagaguuggauccgccauuuggggauucuuacauaguuauaggagugggugacaaaaaaauaacucaccauuggcacagaagcgguucaacaauaggaaaagcauuugaagcaacaguaagaggagccaaacgaauggcaguacucggagauacagcaugggauuuuggaucagucggagguguauuuaacucauuaggaaaagguauacaucagauauucggggccgcuuuuaaaucauuauuuggcggaaugucaugguucagucaaauauuaauuggcacuuuauugguuuggcuaggacuuaauacaaaaaaugggaguauaagccuuaccuguuuagcguuaggaggaguuaugauauuuuugucaaccgcaguaagugcggauguaggaugcaguguagacuucucaaaaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9251 - RNA, 2347 nt, Artificial Sequence
  KF268949.1 prME-long mRNA Design 3 opt
gggagaaagcuuaccaugaggauuauaaacgcaaggaaagagagaaaaagacguggagccgauacaagcaucggaauaauaggccuauuacuaacaacagccauggcagcugagauuacaagaagaggaagcgcauauuacauguauuuagauagaagugaugcuggaaaagcaauaucauuugcaacaaauuuaggaguaaauaaaugucauguccaaauaauggacuuagggcacaugugcgaugcaacaaugagcuaugaauguccaauguuagaugaaggagucgaaccagaugacguagauuguugguguaauacaacaucaacauggguaguauacgguacuugccaucauaagaaaggagaagcgagaagaucaagacgagccgugacucucccgagucacaguacacguaaauuacaaacucgaucacaaacaugguuagaaucucgagaauauacaaaacauuuaaucaaaguagaaaacuggauauucagaaauccaggauucgcacuagccgcaguagcaauagcaugguuauuagggaguaguacuucucaaaaaguaaucuaucucguaaugauccuauuaauugcaccagcauauagcauacguugcauaggaguaagcaacagggauuuuguggaagguaugaguggaggaacauggguagauguaguauuagaacacggagguugcguaacuguaauggcccaagacaaaccaacaguagauauagaacucguaacaacaacaguaucaaauauggcagaaguaagaaguuauuguuaugaagccaguauuucagauauggcaucagacuccagaugcccgacacaaggggaagccuauuuagacaagcaaagugauacacaauauguauguaaacgaacauuaguugauaggggaugggguaauggauguggauuauucggaaaaggaucauuaguaacaugugcaaaauucacuuguuccaagaaaaugaccggaaaaucaauacaacccgaaaacuuagaauacagaauaaugcuaucuguacauggaucacaacacaguggaaugauaguaaaugacgaaaauagggcaaaaguagaagucacaccaaacagcccucgagcggaagcaacauuaggaggauuuggaagucuaggauuagacugugaaccaaggacuggucuagauuuuucggaccuauauuauuuaaccaugaauaacaaacauugguuaguacauaaagaaugguuucaugauauuccauuaccguggcaugcuggugcagauacaggaacaccgcauuggaacaauaaagaagcauuaguagaauuuaaagaugcacaugcaaaaagacaaacaguaguaguuuugggcagccaagaaggugcaguucauacugcacuggcuggagcucucgaagcagaaauggauggagccaaaggaaggcuauuuucaggacacuugaaauguaggcuaaaaauggauaaacuaagauuaaaaggcguaucauauucucuauguacagcggccuuuaccuuuacaaaaguuccagcagaaacucuacauggcacaguuaccguagaaguacaauaugcaggcacagauggaccaugcaaaguaccagcacaaauggcaguagacaugcaaacauuaacacccguagggagauuaauaacagcaaauccaguuauaacugaaucaacugaaaacagcaaaaugauguuggaacuagauccaccuuucggcgauaguuacauaguaauagguguaggagauaagaaaauaacacaucacuggcaucguaguggaagcacaauaggaaaagcauuugaagcaacaguaagaggggcuaaaagaauggcaguacuaggagauacagcuugggacuucggaucaguaggggguguauuuaauagcuuaggaaaaggcauacaccaaauauuuggagcagcauuuaaaaguuuauuugggggaaugaguugguucucacaaauauuaauaggaacuuuauugguuugguuaggucucaacacuaaaaacgguaguauaucauuaacaugucuagcacuaggaggaguaaugaucuuuuuaucaacagcaguaucagcagacguagguuguaguguagauuuuucaaaaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9252 - RNA, 2365 nt, Artificial Sequence
  KU955595.1 prME-long mRNA Design 3 opt
gggagaaagcuuaccaugcgaauaauuaaugcaagaaaagaaagaaaacguaggggagcagacacaucaauuggcauugucggauuauuauuaacaacugcuauggcagcagaaaucacaagaagagguagugcuuauuauauguauuuagauaggagugaugcaggaaaagcaauaucauuugcaaccacacuaggcguaaauaaaugucaugugcagauaauggauuuaggacauaugugcgaugcuacuaugaguuaugaauguccaauguuagaugaaggaguagaacccgaugauguagacuguugguguaacacaacgaguacaugggugguauauggaacaugucaucauaagaaaggagaagcaagaaggaguagaagggccguuacacuaccuagucauaguacaagaaaauuacaaacaagaagccaaacaugguuggaaagccgcgaauacacaaaacauuuaauaaaaguagaaaauuggauuuucagaaauccgggcuuugcccuaguagcaguagcaauugcaugguuacuaggaaguuccacaagucaaaaaguaauuuauuuaguaaugauauuacuaauagcgccagcauacucuauaagguguauuggaguaaguaauagagauuuuguagaaggcaugaguggaggaacuuggguagauguaguacuagaacauggaggaugugucacagugauggcccaagacaaacccacaguagauauagagcuaguaacaacuaccguaaguaacauggcggaaguaagaucauacuguuaugaagcaaguauaucagacauggcuuccgauaguagauguccgacacaaggagaagcguaccuggauaaacaaagcgacacacaauauguauguaaaagaaccuuaguagauagaggauggggaaaugguugugguuuauuuggaaaggguagcuuaguaacaugugcaaaauuuacauguucaaagaaaaugacgggaaaaucaauacaaccugaaaacuuggaauauagaauaaugcuaaguguacauggaucacaacauaguggaaugauaguaaaugauacaggacaugaaacggaugaaaaucgagcaaaaguggaaguaacgccaaacucaccaagagcggaagcgacauuaggagguuucggaucauuaggguuggacugugaaccacgaacaggacuagauuucagugauuuauacuauuuaacuaugaauaacaaacauugguuaguucauaaagaaugguuucaugauauaccauuaccauggcacgcaggcgcagauacgggaacaccacauuggaacaauaaagaagccuuagucgaauuuaaagaugcacacgcgaaacgccaaacuguaguaguuuuaggaucacaagaaggagcaguacauacagcauuagcuggugcauuggaagcggaaauggauggagcaaaaggaagauuauuuagcggucauuuaaaaugucgacuaaaaauggauaaauuaagauuaaagggaguaucauauucacuauguacagcagcauuuacuuuuaccaaaguuccagcugaaacauuacauggaacgguaacuguagaaguacaauaugcaggaacugauggaccuuguaaaguaccugcucagauggcaguugauaugcaaacauuaacaccuguaggacgauugauaaccgcaaauccagugauaacagaaucuacagaaaauaguaaaaugauguuggaauuagauccaccuuuuggugacaguuauauuguaauaggaguaggugauaagaaaauuacacaccacuggcacaggagugguaguacuauaggaaaagccuuugaagcuacaguaagaggagcaaaaagaauggcuguguuaggagauacagcuugggacuuugguucaguuggcggaguuuuuaauucguuagggaaaggcauucaucaaauauucggugcagcauucaaaagccuauucggaggaaugagcugguucagucaaauacuuauaggaacacuauuaguguggcuugguuuaaauacgaaaaauggaucaauaaguuuaacauguuuagcauuaggugguguaaugauauucuuaaguacagcaguaagcgcagauguaggauguucuguagacuucucaaaaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9253 - RNA, 2365 nt, Artificial Sequence
  KF383116.1 prME-long mRNA Design 3 opt
gggagaaagcuuaccaugagaauaauaaaugcaagaaaagagcgaaaaagaagaggagcagacacaucuauugggauaguaggacuauuauuaacaacagcgauggcggcugaaauuacaagaagaggaagugcuuacuauauguacuuagaccgaagugaugcuggcaaagcaauaucguucgcuacaacacuugggguaaacaaaugccacguucaaauaauggacuuaggacauaugugugaugcuacgaugagcuacgaauguccaauguuagaugaagguguagaaccagaugacguagacuguugguguaacacaacaaguacauggguaguuuauggaacaugucaacacaagaaaggggaagcaagacguagcagacgagcagugacacuaccuagucauaguacuagaaaacuacaaacaagaucacagaccugguuagaaaguagagaauauacaaaacaucuaauaaaaguagaaaauuggauauuuagaaaucccggauuugcccuaguugcaguagcaauagcaugguuauuaggaucaagcacaagucaaaaaguaauauauuuaguaaugauauuacuuauagcaccagcuuacagcauuagauguauagguguaucaaauagagacuuuguggaggguaugagcggaggaacauggguugauguaguauuagaacauggaggcuguguuacuguaauggcucaagacaaacccacaguagauauagaauuaguaacgacaacaguaucgaauauggcagaagucagaucuuauuguuacgaagcgagcauaucagacauggcaagugauaguagaugucccacucaaggugaagcauauuuagacaaacaaucagauacacaauauguauguaaaaggacauuaguagaccgggguuggggaaauggaugcggacuauuugguaaaggcagcuuaguuacaugugccaaauuuacauguucuaagaaaaugacaggaaaaaguauacaaccagaaaauuuagaauauagaauuauguuaaguguacauggaagccaacauucaggaaugaucguaaaugacauuggacaugagacugaugaaaauagagcaaaaguagagguaaccccaaauucuccuagggcagaagcaacacucggaggauucggaaguuuaggacuagauugugaaccaagaacaggacuagauuuuucagauuuauacuaucuaacaaugaauaauaaacauuggcuagugcauaaagaaugguuucacgacauuccgcuaccauggcaugcaggagcagauaccggaacaccacauuggaauaacaaagaagcucugguagaauuuaaagaugcacaugcaaaaaggcaaacgguaguaguucuuggaucacaagaaggagcaguacacacggcauuagcaggagcauuagaggcugaaauggauggugcuaaaggucggcuauuuucaggucauuuaaaaugcagguuaaaaauggauaaauugagauuaaaaggaguaagcuauagucuauguacagcuguuugcacagcugcaaaaguaccagcagaaacauuacauggaacuguaacaguagaaguacaauacgcaggaacagauggaccuuguaaaguaccagcacaaauggcuguagauaugcaaacacuuaccccaguaggacgauuaauuacagcaaaccccguaauaacagagucaacggaaaauaguaaaaugauguuagaauuagacccucccuuuggugauucauacauaguaauaggaguaggagauaagaaaauaacacaccauuggcacagaucaggcucaacaaucggaaaagccuucgaagcuacaguacgaggagcaaaaagaauggcaguauuaggagauacugcaugggauuuuggcaguguaggaggaguauuuaauaguuuagguaaagguauucaucaaauuuuuggagcagcuuucaaaucauuauucggaggaaugaguugguuuucacaaauacuuauaggaacacuauuaguaugguuaggacuuaauacgaaaaacgggucaaucagcuuaacauguuuagcacuagguggcguaaugauauuucuuucaacagccguuagugcagauguaggcuguuccguugauuucagcaaaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9254 - RNA, 2347 nt, Artificial Sequence
  KU963574.2 prME-long mRNA Design 3 opt
gggagaaagcuuaccaugagaauaauaaacgcuagaaaagaacggaagagaagaggagcugaugcgucaauaggaauaguaaguuuauuauuaacaacaguaauggcugcagaaauuacaaggagaggaucagcuuauuauauguauuuagacagaagugaugcgggaaaagcaauaaguuuuguaacaacauuaggaguaaauaaaugucauguccaaauaauggacuuggggcauaugugcgaugcaacaaugucuuaugagugcccaauguuggaugaaggaguugaaccagaugauguagauuguugguguaauacaacaucaacuuggguaguauacggaacaugccaccacaagaaaggggaagcuagaagaucaagaagggcaguaacauugccaagucauaguacgagaaaacuacaaacacguagccagacauggcuugaaucaagagaauauacaaaacacuugauaaaaguagagaauuggauuuuccgaaauccagguuucgccuuaguugcaguagcaauugcaugguuacuaggaagcagcacuucucaaaaaguaauauauuuaguaaugauauuacuaauagcaccagcauauucaauaagauguauaggagugaguaacagagauuucguagaagguaugaguggaggaacauggguagacguaguacucgaacacgguggaugcguaacaguaauggcucaagacaaaccaacaguagauauugaacucguaacaacaacaguaucaaauauggccgaaguuaggucuuauugcuaugaggcaucaauaucagacauggcaucagauagcagauguccuacacaaggagaagcauauuuagauaaacaaucagacacacaauacguaugcaaaagaacauuaguagauagaggcuggggaaacggcuguggacuguuugggaaaggaucucucguaacaugcgcuaaauucaccuguaguaagaaaaugacaggaaaaaguauacaaccagaaaaccuagaauauagaauuauguuaagcgugcauggaagccaacacagcgggaugauaguuaaugaugaaaauagggcaaaaguagaggucacgccaaacagcccaagagcagaagcaacauuaggagguuucggaagccucggauuagauugugaaccaaggacuggauuagauuucucagauuuauauuaucuuacaaugaauaacaaacacuggcuaguacauaaagaaugguuucacgauauuccauuaccauggcauucaggagcagacacugaaacaccacacuggaauaauaaagaagcguugguagaauuuaaagaugcacacgcaaaaagacaaaccguaguagucuuagguucgcaagaaggagcaguacauacagcacuagcaggcgcgcuagaagcugaaauggauggugcaaaaggaagacugucaucaggucaucuaaaauguagauuaaaaauggauaaauuaagacuaaaagguguaucauauuccuuauguaccgcagcguuuacuuucacaaaaguuccagccgaaacauuacauggaacaguaacuguagaaguacaauaugcagggcgagacggaccuuguaaaguuccagcacaaauggcaguugauaugcaaacauuaacaccaguugggagauuaauaaccgcaaacccaguaauaacugaaucaaccgaaaauucaaagaugauguuagaauuagaucccccauuuggagacuccuauauagugauaggaguuggagauaagaagauaacccaucauuggcauagaucaggaagcauuauaggaaaagcauuugaagcaacaguaagaggcgcaaaaagaauggcaguacuaggcgauacggcaugggacuuuggaucagugggaggaguuuucaacagucuaggaaaagguauucaccaaauauucggagccgcauucaaaagccuauucggagguaugucaugguuuucacagauucuaauaggaacgcuucuaguaugguugggauuaaauacuaaaaauggaaguauaucacuaacaugucuugcuuuaggaggaguaaugauauucuugucaacagcaguuucugcagacguuggaugcaguguggauuuuaguaaaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9255 - RNA, 2347 nt, Artificial Sequence
  KX601166.1 prME-long mRNA Design 3 opt
gggagaaagcuuaccaugagaauaauaaaugcaagaaaagaaagaaaaagaagaggagcugauacaucuauuggaauaguaggcuuguuauuaacaacagcuauggcagcagaaauaacaagaagaggaagcgcuuacuauauguauuuagacaggagugaugccggaaaagcaauaucauuugcaacaacauuaggggucaauaaaugucauguccaaauaauggacuuaggacauaugugcgacgcaacaaugaguuaugaguguccaauguuggacgaaggaguagaaccagaugauguagauuguugguguaauacgacuuccacauggguaguuuacggaacuugucaucauaagaaaggagaagcuagaagaagcaggagagcaguaacacuaccaucacauaguacuagaaaacuucaaacaagaagccaaacauggcuagagucaagagaauauacaaaacacuugauaaaaguagaaaauuggauauuuagaaauccaggcuuugcauuaguggcaguagcuauagccuggcuuuuaggaagcaguacaagucaaaaaguaauauauuuaguaaugauauuauuaauagcaccagcauauucaaucagaugcaucggagugaguaauagagacuucguagaagguaugagcggaggaacauggguagaugugguacuagaacacggaggcuguguaacaguaauggcacaagauaagccgaccguagauauugaauuaguaaccaccaccgugaguaauauggcagaaguuagaucauauugcuaugaagcaaguaucagugauauggcaagcgauaguagauguccgacacaaggagaagcauaccuagauaaacaaagcgacacacaauacguauguaaaagaacacucguagauagaggauggggaaacggauguggauuauuugggaaaggaucccuaguaacaugugccaaauuuacuuguucgaagaaaaugacuggaaaaaguauacaaccugaaaacuuagaauauagaauaaugcuaucaguacaugguagccaacauagcggaaugauaguaaaugaugaaaacagggcaaaaguagaaguaacgccuaauagcccaagagcagaagcuacacuagguggauuuggaaguuuaggacuagauugcgaaccacgaacgggguuagauuuuagugacuuauauuauuuaacuaugaacaauaaacauugguuaguacacaaagaaugguuucacgacauaccauuacccuggcaugcaggagcggauacaggaacaccacauuggaauaacaaagaagcucuaguggaauuuaaagaugcacaugcaaaaaggcaaacaguuguaguacugggaucacaagaaggagcgguucauacagcccuagcaggagcacuagaagccgaaauggauggagcgaaaggaagauuauucucaggacauuuaaaaugucgauuaaaaauggacaaacuacgauuaaaaggaguuaguuacucauuauguacagcagccuucacguuuacaaaaguaccagcagaaacacuacacggaacaguaacuguagaaguacaauacgcuggaacagauggaccuuguaaaguaccugcccaaauggcgguagauaugcaaacauuaacaccuguggguagguuaauaacagcaaauccaguaauaacugaaucaacagaaaacaguaaaaugauguuagaauuagauccacccuuuggugauagcuauauagucauaggaguaggugacaagaaaaucacacaucauuggcaccgaaguggcucaacgauagguaaagcauucgaagcaacaguucgaggagcuaaaagaauggcaguacuaggagauacagccugggauuuugggaguguagguggaguauucaauagccuagggaaaggaauacaccaaauauucggggcagcauucaaaagucuauuuggugguaugaguugguuuucacaaauauuaauaggcacuuuauuaguauggcuaggguuaaauacuaaaaacggaagcauuagcuuaacaugccuagcgcugggagguguaaugauauuucuaaguacagcaguaagugcagauguaggauguagcguugauuuuucaaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9256 - RNA, 2365 nt, Artificial Sequence
  KF383118.1 prME-long mRNA Design 3 opt
gggagaaagcuuaccaugagaauuauaaaugcaagaaaagaaagaaaaagaaggggagcugacacuucaauaggaauaauaggauuacuacuuaccacagcaauggcagcagaaauaacacgaagaggaucugcauauuacauguaucucgauagaagcgacgcagguaaagccauaaguuuugcaaccacauuagguguaaauaagugucauguacaaaucauggacuuaggacauaugugugacgcaaccaugagcuaugaaugcccuaugcuagacgaaggaguagaacccgaugacgucgacuguuggugcaacacuacaagcacaugggucguuuaugguaccugucaucauaagaaaggagaaacucgaagaucaagaagaaguguaucucuuagauaucauuacacaagaaaacuacagacaagaucucaaacauggcuagaaucaagagaauauaagaaacaucuaauaaugguugaaaauuggauauucaggaacccaggauuugcaauaguuaguguugcaauaacauggcuuaugggaaguuuaacaagccaaaaaguuauauacuuaguaaugauaguucuaauuguaccagcuuauucaauaagcugcauaggagugaguaacagagauuuagucgaaggaaugucagguggaacauggguagauguaguauuagaacaugggggaugcguuacagaaauggcccaagauaaaccgacaguagauaucgaauuaguaacaaugaccguaucaaacauggccgaaguaagaucauauuguuaugaagcaucacuaucagauauggcaagugcaagcagaugcccaacucaaggggaaccaucucuagauaaacaaucagacacacaaucaguaugcaaaagaacauugggugauagaggauggggcaacggcuguggcauuuuuggaaaaggaagucuaguuaccuguaguaaauucacgugcuguaagaaaaugccaggaaaaaguauucaaccagaaaaccuugaauacagaauuauguuaccaguacauggaucgcaacauaguggcaugauagugaaugauauaggucacgaaacagacgaaaauagagcaaaaguugaagugacaccaaacaguccaagagcagaagcaacauuaggaggauuuggaucauuaggauuagauugugaaccacgaaccgggcuagauuucagcgaucuuuauuacuuaacgaugaauaauaaacacuggcuaguacauaaagaaugguuccaugacauaccauuaccauggcacgcaggagcagauacuggaacuccacauuggaauaauaaagaagcacuuguugaguucaaagaugcacaugcaaaaaggcaaacaguaguaguacuaggaagccaagaaggagcuguucacacagcguuagcaggcgcacuugaagcugaaauggauggagcaaaaggaagauuguuuucaggacauuuaaagugcagacuuaaaauggacaaacuaagacuaaaaggcgucucuuacucauuauguacagcagcauuuacauucacuaaagugccagcagaaacacuacauggaacugucacaguagaaguccaaucugcagguacagauggcccauguaaaguacccgcccaaauggcaguugacaugcaaacgcugacaccaguagguagacuaauaacagcaaacccuguaaucacagaaucaacagaaaacuccaaaaugauguuagaacuagauccaccuuucggagauaguuauauuguaauuggaguaggagauaagaaaauaacacaucauuggcauagaagcggaaguacuauaggaaaagccuucgaagcuacaguaagaggcgcuaaaaggauggcugucuuaggugauacagcuugggauuuuggaucaguaggggguguauucaauagucuaggaaaaggaauacaucaaauuuuuggagccgcguucaaaaguuuauucggagguaugucgugguuuucacaaaucuuaauaggaacauuacugguauggcuaggacuaaauacuaaaaauggcaguauuagcuuaacauguuuagcuuuaggaggaguaaugauauuucuuagcacagcaguuagugcggaugucggauguucuguagacuuuucuaaaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9257 - RNA, 2359 nt, Artificial Sequence
  KF383120.1 prME-long mRNA Design 3 opt
gggagaaagcuuaccaugagaauuauuaacgcucguaaagaaagaaaaagacguggugcagacacaagcauagggauaauagguuugcuauuaacaacugcaauggcugcugaaauaacaagacgaggaucagcauauuauauguaccuggauaggucugaugcaggaaaagcaauaucauucgcaacuacaaugggaguaaauaaaugucauguacaaauaauggauuuaggacacaugugugaugcuacaaugaguuaugaauguccuauguuagacgaaggaguagaaccugaugauguugacuguugguguaauacuacuagcacauggguuguauaugggaccugccaucauaagaaaggagaagcaaggccaucaagacgagcagucacauuaccgagucauaguacucgaaaauuacaaacucgaagucaaacgugguuagaaucacgugaauacacaaaacacuuaauaaaaguagaaaauuggauacuucgaaacccuggguuuacgguagcagccuuagcaauggcauggcuucuaggaaauaguacaagucaaaggguaauauaccuaguaaugauuuuauuaauagcacccgcauauucaauaagaugcauaggaguaagcaauagagauuuuguagaagguaugucaggaggaacauggguagauguuguacuagaacacggcggaugcguaacaguuauggcucaagacaaaccaacaguagauauagaauuaguaacuacaacaguaucaaauauggcugaaguaaggaguuauuguuaugaggcaaguaucucagauauggcaagugacaguaggugcccaacccaaggcgaggcuuaucuagauaaacaaagugauacucaauacguauguaaaaggacgcuaguagauagaggauggggaaacgguuguggacuauuuggaaaaggaagccuaguaacaugugccaaauuuacauguucaaagaaaaugacaggaaaaaguauacaacccgaaaaucuagaauauagaauuaugcuaaguguacauggaucucaacacucaggaaugauaguaaaugacauaggacaugaaacagaugaaaauagagcaaaaguggaaguuacaccaaauaguccaagagcagaagcuacacuggguggauucgggagcuuaggguuagauugugaaccaaggacaggauuagauuucucagaucuauacuaucuaacaaugaacaacaaacauugguuaguucauaaagaaugguuucacgacauaccacuaccauggcacgcaggagcagauacaggaacaccacauuggaacaauaaagaagcauuaguagaguucaaagacgcacaugcuaaaagacagacaguaguuguucuaggaagccaagaaggagcuguacauacagcacuugcaggagcacuugaagcagaaauggauggugcaaaagggagacuuuucagcggacacuuaaaaugccgaauaaaaauggauaaauuaagauuaaaaggugucucguauucuuuauguacagcagcauuuacauuuaguaaaguaccagcagaaacauuacaugguacgguaacagucgaaguacaauaugcaggaagagauggaccauguaaaguaccagcacagauggcaguagauaugcaaacauuaacaccuguagggagauuaauaacggccaauccuauaauaacagaaaguacagaaaauucacgcaugaugcuugaacucgauccaccauucggagauaguuauauagugauaggaguaggugauaagaaaauaacccaucauuggcauagaaguggaaguacuauagguaaagcauucgaagcaacagugagaggagcuaaacgaauggcaguauuaggcgauacagcuugggauuuugguaguguagguggaguauucaauagucuaggaaaaggaguacaccaaguauucggagcggcauuuaagagcuuguucggaggaaugagcugguucucacaaauacuuauagguacauuauuaguauggcuaggauuaaauacuaaaaacggaaguauuucauuagcaugucuugcucuagguggugcaaugauuuuucuaagcacugccguuucugcagacguugguuguagcguagauuucugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9258 - RNA, 2290 nt, Artificial Sequence
  KU321639.1 prME-short mRNA Design 3 opt
gggagaaagcuuaccaugacuagcguaggaauaguaggauuauuauuaacgacagcaauggcugcagaaguaacucgacgcggaucagcauauuauauguaccucgacagaaaugacgcaggagaagcaauuaguuucccuacaacauuagggaugaauaaauguuauauccaaaucauggauuuaggacacaugugugaugcaacaaugagcuacgaauguccaauguuagacgaagguguagaaccagacgacguagacuguuggugcaauacaacaucaacauggguaguauaugguacaugccaucauaagaaaggcgaagcuagaagaaguagacgagcaguaacacuaccaucacauagcacaagaaaauuacaaacaagaucucaaaccuggcuagaaucaagagaauauacuaaacauuugauaagaguagaaaauuggauauuuagaaauccaggauucgcuuuagcagcagcugccauugccuggcuuuuaggaucaucaacaagccaaaaaguaauauauuuaguaaugauauugcuuauagcgccagcauacagcauaagauguauaggaguuucaaauagagauuuugucgaaggaaugagcggaggaacauggguagauauaguacuugaacauggaggaugcgugacaguuauggcccaagacaaaccuaccguagacauagaauuaguuacaacuacuguaucuaauauggccgaaguaagaaguuauugcuacgaggcuucaauuagugacauggcaucagauucuagaugcccaacucaaggugaagcauaccuagacaaacaaagugacacgcaauacgucuguaaaagaacauuaguagacagaggauggggcaauggaugcggauuauucggaaaaggcagcuuaguaacuugugcaaaauucgcauguagcaagaaaaugacaggaaaaucaauacaaccagaaaacuuagaauacagaaucauguugucaguucauggcagccaacauucaggaaugauaguaaacgauacuggacaugaaaccgaugaaaauagagcaaaaguagaaauaacuccaaauaguccuagagccgaagccacauuaggugguuuuggaucauuaggacuagauugugaaccacgaacaggacuagauuuuagugauuuauauuaucuaacgaugaauaauaaacauugguuaguacauaaagaaugguuucaugauauaccacuuccauggcaugcaggagccgauacuggaaccccacacuggaauaauaaagaagcauuaguugaguucaaagaugcccacgcaaagagacaaacaguaguaguauuaggaucacaagaaggggcaguacauaccgccuuagcuggagccuuagaagcagaaauggacggagcuaaaggaagacugaguagcggacacuugaaaugucgacugaaaauggauaaguuaagguuaaaaggaguaaguuauaguuuauguacagcugcauuuacauuuaccaaaauaccagccgaaacccugcaugggacgguuacaguagaaguacaauaugcaggaacggauggaccauguaaaguaccagcgcagauggcaguugauaugcaaacacuaacaccaguaggaagacuuauaaccgcaaauccggugauaacagaaaguacagaaaacuccaaaaugauguuagaauuagauccaccauuuggagacucauauauagugauaggagugggagaaaagaaaauaacacaccauuggcauagaaguggaaguacaauaggaaaagcguucgaagcaaccguaagaggagcaaaaagaauggcaguucuaggagauacugcaugggauuucgguagcguaggaggagcauuaaauucacuaggaaaaggaauccaucaaauauuuggagcagcauucaaaaguuuauucggaggaaugaguugguuuucccaaauacuaauaggaacacuauuaaugugguuaggauugaauacgaaaaauggaucuauaucgcugaugugucuagcauuaggaggagucuuaauuuucuuaucaacagcaguaucagcgugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9259 - RNA, 2290 nt, Artificial Sequence
  KU312312.1 prME-short mRNA Design 3 opt
gggagaaagcuuaccaugacaucaguuggaauagucggacuucuuuugacaacagcaauggcugcugaaguuacgcgaagaggaagugccuauuacauguauuuggacagaaaugaugcaggagaggcuauuucauucccaacaacauuagggaugaacaaauguuauauacaaauaauggaucuuggucauacaugcgacgcgacgaugucauacgaauguccaaugcuugaugaaggaguagaaccugacgauguagacuguuggugcaacacaacaucaacuuggguaguauauggaacuugucaucacaaaaaaggggaggcaaggagaucacguagagcaguuacacuaccuucacauaguacaagaaaacuacaaacaagaucacaaacauggcucgaaucacgagaauauacaaaacauuuaauaaggguagaaaauuggauuuucagaaacccaggauuugcccuugcagcagcagcaauugcauggcuuuuaggaaguagcacaagucagaaagugauauacuuagugaugauuuuacuuauagcuccagcauauucuauaagaugcauaggaguaaguaauagagacuucguagaaggaaugaguggggguacuuggguagauguuguacuugaacacggcggaugcguaacaguaauggcccaagauaaaccaacuguagauauagaauuaguaacgacaacaguuucaaauauggcagaaguaagaucauauugcuacgaagcauccauaucagacauggcuucugauucuagauguccaacucaaggugaagccuauuuagauaaacaaucagauacucaauauguauguaaaagaaccuuaguagacagagguuggggaaauggaugcggauuauuuggaaaaggaagucuaguaacgugugcaaaauuugcaugcaguaaaaaaaugacuggaaaaaguauucaaccagaaaaccuugaauauagaauaauguugaguguacaugguagccaacauucaggaaugauaguaaaugauacaggccacgaaacagacgaaaauagagcaaaaguugaaauaacaccaaauagucccagagccgaagcaaccuuaggaggauucggaucucuaggauuagacugcgaaccuagaacaggacuagacuuuucagaucuuuacuauuuaacaaugaauaauaaacauuggcuagugcauaaggaaugguuucacgauauaccauuaccauggcaugcaggagcugauacagguacaccacauuggaauaauaaagaagcacuuguagaauucaaagacgcacacgcuaaacgacaaacaguaguaguauuagguagucaagaaggagcaguucauacagcauuagcuggggcauuagaagcagaaauggauggagcaaagggaaggcuaucaucaggacauuuaaaaugcagauuaaaaauggauaaauugagacucaaagguguaucauauucucuauguacagcagcuuucacuuuuacaaaaauaccagcagaaacucuucaugggacuguuacaguugaaguacaauaugcaggaacagaugguccaugcaaaguaccagcacaaauggcaguagauaugcaaacauuaacaccaguaggaagacugauaacagcaaacccaguaauaacagaaagcacagaaaauucaaaaaugauguuagaauuagauccuccauucggagauucauauauagucauaggaguaggagaaaaaaaaauaacacaucauuggcauagaucaggaucaacuauaggcaaagcauuugaagcaacaguaagaggcgcaaaaagaauggccguacuaggagacacagcuugggacuucggaagcguaggaggagcacuaaauaguuuaggaaaaggaauucaccaaauauuuggagcagcauuuaaaaguuuauucggaggaaugagcugguucucacaaauauuaauagguacuuuacuaaugugguuaggacuaaaugccaaaaacggaucaauaagcuuaaugugcuuagcucuuggaggugugcuaauauuccuuucaacagcaguaagugcuugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9260 - RNA, 2278 nt, Artificial Sequence
  AY632535.2 prME-short mRNA Design 3 opt
gggagaaagcuuaccaugacaucaauuggaauaauuggucuuuuacuuacuacagcaauggcagcagaaauaacaagaagaggaucagcauauuauauguauuuagaccguagcgaugccggaaaagcaauaucauucgcuacaacauuaggaguuaauaaaugucauguucaaauaauggacuuaggacauaugugugaugcaacuaugucuuaugaauguccaaugcuagacgaaggaguagaaccagaugauguagauugcugguguaauacuacuagcacauggguuguauaugguacaugucaucauaagaaaggcgaagcuagaagaaguagacgagcaguaacuuuaccaucucauucgacaagaaaauugcagacgagaucacaaacaugguuagaaaguagagaauauacuaaacauuuaauuaaaguagaaaacuggauauuuagaaauccggguuuugcauuaguggcagucgcuauugcaugguuauuaggcucaucaacgagucaaaaaguaauauaucuaguaaugauacuauugauagccccagccuauucaauaagaugcauaggaguaaguaauagagauuuuguagaagguaugagcggaggcacuuggguagaugucguuuuagaacacggaggaugcguaacaguaauggcucaagacaaaccaaccguagauauagaguuaguuacaacaacaguaaguaauauggcagaaguucgaucuuacuguuaugaagcaucaauaucagauauggcuagcgacucuagaugccccacacagggagaagccuacuuagauaaacaaagugauacccaauacguauguaaaagaacccuaguagauagaggauggggcaaugggugcggacuauuugguaaaggaucucuagugacaugcgcaaaauucacaugcucaaagaaaaugacaggaaaaaguauccaaccagaaaauuuagaauauagaauaauguuaucuguacauggcucacaacauucagguaugauaggauaugaaacugaugaagacagagcaaaaguagaagucacaccaaacuccccaagagcagaagcaacacuuggcggguuuggaaguuuaggauuagacugugaaccuagaacaggauuagacuucagugauuuauauuaccuaacgaugaacaauaaacacugguuaguacauaaagaaugguuucacgacauaccauuaccguggcaugcaggagcagauacuggaacaccucauuggaacaauaaagaagcauuggucgaguucaaagaugcucaugcaaaaagacaaaccguaguaguauuaggaucacaagaaggagcuguacauacagcauuagcaggagcgcuagaagcagaaauggauggagcaaaaggaaggcuauucucaggccaucuaaaauguaggcuuaaaauggauaaacuacgacugaaaggaguaaguuacucauuauguacagcagccuucaccuucacgaaaguaccagccgaaacucuacacggaacaguaacuguagaaguacaauaugcagguacagauggacccuguaaaauaccaguacaaauggcaguagauaugcaaacauuaacaccaguaggaagauuaauuacugcaaauccaguaauaacagaaaguacagaaaauucaaaaaugaugcuugaacuugaucccccauuuggagauucauauauaguaauaggaguaggagauaagaaaauaacacaucauuggcauagaucaggaucgacaauuggaaaagcauucgaagcaacaguaagaggagcgaaaagaauggcuguauuaggagacacagcgugggauuuuggaucagugggaggugucuuuaauagcuuaggaaagggaauacaccaaauauucggugccgcguuuaaaucacucuuuggaggcaugucaugguucagucaaauacuaauaggaacucuguuaguguggcuaggauuaaauacgaaaaauggaagcauuagcuuaacauguuuagcauuaggaggagugaugauauuccuaaguacagcaguaucagcaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9261 - RNA, 2290 nt, Artificial Sequence
  KU527068.1 prME-short mRNA Design 3 opt
gggagaaagcuuaccaugacaucaguaggaauuguuggauuauuacuaacaacagcuauggcagcugaggucacaagaagaggaucugcauauuauauguauuuagauaggaaugaugcaggagaagcuauaaguuucccgacaacccuagguaugaauaaauguuauauucaaauaauggaucuaggacacaugugugaugcuacaaugucauacgaaugcccuauguuagaugaaggcguagaaccagacgauguagauugcugguguaauacaacgagcacauggguaguauauggaacuugccaucauaagaaaggagaagcuagaagaaguaggagagcuguaacauuaccuagucauaguacaagaaaauuacaaacaagaucgcaaacaugguuggaaucaagagaauauacgaaacauuuaauaagaguagaaaauuggauauuuagaaauccaggguucgcuuuagcagcggcugcuauugcaugguuauuagggaguagcacuucacaaaaaguaauauauuuagugaugauauuauuaauagcuccagcauauucaauaagaugcauaggagugucaaauagagauuucguagaaggaaugucggguggaacauggguagauguaguuuuggaacauggcgguugcguaacaguaauggcucaagacaaaccuacaguagauauagaauuaguaacaacaacaguaaguaauauggcagaaguuagaucuuauugcuaugaagcaucaauuucagauauggcaagugacucacgaugccccacacaaggggaagcauaccuagacaaacaaucagauacucaauacguauguaaaagaacauuaguagaccgggguuggggaaacggaugcggucuauucggaaaaggaagucuaguaacaugugcuaaauuugcauguaguaagaaaaugacagggaaaaguauucagccugaaaacuuagaauauagaauaaugcugucuguacauggaagucaacauagugguaugauaguaaaugauacaggacaugaaacagacgaaaauagggcaaaaguggagaucacgccaaacaguccuagagcagaagcuacacuaggagguuuuggaagucuagggcuagauugugaacccagaacuggauuagauuuuucggauuuauacuacuuaacaaugaacaacaaacacugguugguccauaaagaaugguuucaugauauaccauuaccauggcaugcgggcgcagauacaggaacaccacauuggaauaacaaagaagcauuagucgaauuuaaagaugcccaugcaaaaagacaaaccgugguagucuuaggaagucaagaaggagcaguacauacagcacuagcuggcgcgcuugaagcagaaauggauggagcuaaaggaaggcuaucgucaggacauuuaaaauguagguugaaaauggauaaacuaaggcuaaaaggaguuaguuauagcuuguguacugcagcauucacguuuacaaaaauaccagcagaaacauuacacgguacaguuacaguugaaguacaauaugcagggaccgauggaccauguaaaguacccgcacaaauggcuguagauaugcagacacuaacacccguaggaagacuaauaacagcaaauccugucauaacagaaaguacagaaaacucaaaaaugaugcuugaauuagauccaccauuuggagauucuuacauaguaauaggaguaggagaaaagaaaauaacucaucacuggcaucgaaguggaaguacaauaggaaaagcauuugaagcaaccguuagaggagcaaaaagaauggcaguauuaggagacacagcuugggauuuuggaagcguaggaggagcauuaaacucauuagggaaagguauacaucaaauuuucggagcagcauuuaaaagucuauuugggggaaugucaugguuuagucaaauauuaauagguacauugcuaaugugguuaggacuaaauacuaaaaauggaaguauaaguuuaauguguuuagcacuuggaggaguacuaauauuuuuaagcacagcaguaagugcaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9262 - RNA, 2290 nt, Artificial Sequence
  KX421193.1 prME-short mRNA Design 3 opt
gggagaaagcuuaccaugaccucaaucgguauuauaggacuacuauuaacaacagcaauggcggccgaaauaacgagaagaggaucagcauauuacauguaucuagaccgaagugaugcaggaaaagcaauaucuuuugcuacaacacuaggaguaaacaaaugucauguacaaauuauggacuuaggacauaugugugacgcgacaaugucauacgaaugucccauguuagaugaaggaguugaaccagaugauguagacuguugguguaacacaaccaguacuuggguaguauacgguacaugccaucacaagaaaggagaagcaagaagaaguagacgagcagugacauuaccaagccacucaacgagaaaauuacaaacaagaagucaaacauggcuagaaaguagagaauacacuaaacaucuaauaaaaguagaaaauuggaucuucagaaauccaggauuugcauuaguagcaguugcaauugcaugguuauuaggaucaucaaccagccaaaaaguuauuuauuuaguaaugauccuauuaauugcaccagcauacaguauuagaugcaucggcguuucaaauagagauuuuguugaagguaugucaggaggaacauggguagauguaguauuagaacaugguggauguguaacuguuauggcacaagauaaaccuacaguggacauugaauuaguaacaacaacaguauccaacauggcagaaguuagaucauacugcuaugaagcaagcauaagugacauggcuucagauucaagauguccuacacaaggagaagcauaucuggacaaacaaucagauacucaauaugucugcaaaagaacauuaguugauagaggcuggggaaaugggugcggcuuauucggaaaagguagucuagucacaugcgcuaaauuuacauguaguaagaaaaugacaggaaaaucaauccagccagaaaacuuagaauacagaauuauguugucaguacauggaucucaacauagugguaugauuguaaacgauacaggauacgaaacagaugaaaauagagccaaaguagaaguuaccccuaacucaccaagagcagaagcaacucuaggaggauuuggauccuuaggacuagauugugaaccaagaacaggcuuagauuuuucagaucuauauuaccuuacaaugaacaauaaacacugguuaguacauaaagaaugguuccacgauauaccacuaccauggcacgcaggagcggacaccgguacaccacacuggaauaauaaagaagcauuaguugaguucaaagaugcucaugccaaaagacaaacaguaguaguuuuaggaucucaagaaggagcaguacauacagcuuuagcaggagcauuagaagcagaaauggacggagcaaaaggaaaauuauuuucaggacauuuaaaaugcagauuaaaaauggacaaauugagauuaaaaggcguaaguuauucacuauguacggcagcauucacauuuacuaaagucccagccgaaacacugcauggaacaguuacaguagaaguucaguacgcaggcacagauggaccaugcaaaauaccuguacaaauggcaguagauaugcaaacccuaacaccagucggaagacuuauaacugccaauccaguuauaacagaaucaacugaaaacuccaaaaugauguuagaauuagauccaccauuuggagacaguuauauaguaauuggaguaggagacaagaaaauuacacaucacuggcaucgaaguggaaguacaauaggaaaagcauuugaagcuacaguaagaggagcuaaaagaauggcaguacuaggugauacagcaugggauuuugguucuguaggagguguauuuaauagucuuggaaaaggaauacaucaaauauuuggagccgcauuuaaaucauuauuuggaggaaugucaugguucucacaaauacuaauuggcacauuauuaguauggcuaggacuaaacaccaaaaacggaagcauaaguuuaacaugucuagcacuaggaggaguaaugauauuucuaaguacagcaguaagcgcaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9263 - RNA, 2290 nt, Artificial Sequence
  KX377335.1 prME-short mRNA Design 3 opt
gggagaaagcuuaccaugacaucaauaggaauuauuggucuacuucuaacaacagcaauggcugcagaaauaacaagaagaggaagugcauauuacauguauuuagacagaucagacgcuggaaaagcgaucaguuucgcaacaacuuuaggaguaaauaaaugucauguacaaauaauggauuuaggucacaugugugacgcaacuauguccuaugaauguccaauguuagacgaaggaguugaaccagaugauguugauuguugguguaauacaacaucuacaugggucguauauggaacaugucacaggaaaaaaggggaagcaagaagaucuagaagggcaguaaccuuaccaagucauucaacaagaaagcuacaaacaagaagccaaacauggcuagaaaguagagaauacacuaaacacuuaauuaaaguagaaaauuggauauuuagaaauccaggauucgcauuaguugcaguagcaauagcaugguuauuaggcucgucaacaagucaaaaaguuaucuauuuaguaaugaucuuacuaauagcuccagccuauucaauuaggugcaucggcguaucaaauagagacuuuguagaaggaaugagcggagguacauggguagacguaguauuagaacauggaggaugcguaacaguuauggcucaagauaaaccaaccguagauauagaacuaguaacaacaacaguuaguaauauggcagaaguuagaagcuauugcuaugaagcgucuauaucagauauggcaucagauaguagguguccaacacagggagaagcauacuuagacaaacaaucggauacucaauauguauguaaaagaacauuaguagauagaggcugggguaacggaugcggauuauucggaaaaggaucauuagugaccugugcuaaauuuaccugcucaaaaaaaaugacgggcaaaucaauacaaccugaaaaucuagaauaccgcauaaugcuuaguguacauggaucccagcauucaggaaugauaguaaacgauacaggcuacgaaacagaugaaaauagagcaaagguagaaguuacaccuaauucaccacgagcagaagcaacauuaggaggauuuggaagucuagguuuagauugugaaccaagaacaggauuagauuuuucagaucuauauuauuuaacaaugaacaauaaacauuggcuaguacauaaagaaugguuucaugauauaccauuaccuuggcaugcaggugcagauacaggaacaccucauuggaauaauaaagaagcccuugucgaguucaaagaugcacacgccaaaagacaaacuguagucguacuaggaagucaagaaggugcaguacacacagcuuuagcaggagcacucgaagcagaaauggacggagcgaaaggaaaacuguucagcggacauuuaaaaugccgauuaaaaauggacaaauugagacuaaaaggaguaucauacucuuuauguacagcagcauuuacauuuacaaaaguuccagcagaaacauuacauggaacaguaaccguagaaguacaauaugcaggaacugacgguccaugcaaaauaccaguucaaauggcaguagacaugcaaacauuaacuccaguggguaggcuaauuacagcaaacccuguaauaacagaaagcacggaaaacucuaaaaugauguuagaacuagauccaccauuuggagauucauacauaguaauuggaguaggagauaaaaaaauuacacaucauuggcauagaaguggaucaacaauaggaaaagcauucgaagcaacuguacgaggggcaaaaagaauggcaguacuaggcgacacagcaugggauuuuggaaguguuggggguguauuuaauucuuuaggaaaaggaauacaucaaauauuuggagcggcauucaaaucauuauuuggaggaaugagcugguuuagucaaauuuuaauagguacuuugcuaguaugguuaggauuaaauacaaaaaacggaucaauaagccuaaccuguuuggcuuuaggaggaguaaugauauucuuaagcacagcagucagugcaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9264 - RNA, 2290 nt, Artificial Sequence
  LC002520.1 prME-short mRNA Design 3 opt
gggagaaagcuuaccaugaccagcauaggaauaaucggacuguuauuaacgacagcuauggcagcugaaauaacaagaaggggauccgcguacuacauguacuuagauagaucugaugcuggaaaagcaauaucauucgcuacaacacucggaguaaacaaaugucauguacaaauaauggaucuaggacacaugugugaugccacaauguccuacgaauguccuauguuagaugaaggaguugagccagaugauguagauugcugguguaauacaacuuccacauggguaguauauggcacaugccaucacaagaaaggagaagcuagaagaaguaggagagccguaacacuaccaagccauaguacaaggaaauuacaaacaagaagucagacuuggcuagaaaguagagaauauacaaaacaucugauaaaaguagaaaauuggauauucagaaauccaggauuugcucuaguagcaguagcaauagcaugguuauuaggaagcucaacaagccaaaaaguuaucuauuuaguaaugauauuauuaauagcuccagcguauuccauaagaugcauaggaguaaguaauagagacuuuguagaaggaaugaguggugggacauggguagauguugucuuagaacaugggggauguguaacagugauggcucaagacaaaccaacaguugacauagagcuaguaacuacaacaguaaguaacauggcagaaguaagaucauacuguuaugaagccuccauaucagauauggcauccgacagucgauguccaacacaaggugaagcauauuuggacaaacaaagugauacacaguauguaugcaagagaacauuaguugauagaggaugggguaacggguguggauuauuuggaaaagguucacuggugacaugugcaaaauuuacaugcucaaagaaaaugacuggaaaaagcauacaaccagaaaauuuagaauauagaauuauguuaucaguucacggaagccaacauaguggaaugacuguaaaugacauaggauaugaaacagacgaaaacagagcaaaaguugaaguaacgccaaauucaccuagagcagaagcuacauuaggaggauuuggcaguuugggauuagauugugaacccagaacaggacuugacuucagugauuuauauuaucugacaaugaacaauaaacauugguuaguacauaaagagugguuucaugauauaccauuaccguggcaugcaggagcagacacaggaacuccacacuggaacaauaaagaagcucuaguagaauuuaaagacgcacacgcuaaaagacaaacaguaguagucuuagggucacaagaaggcgcaguacacacagcuuuagcaggagcauuagaagcagaaauggacggcgccaaaggcaaacuauuuucuggccauuuaaaguguaggcuaaaaauggacaagcuaagauuaaaagggguaucauauucauuaugcacagccgccuuuacauuuacaaagguuccagcagaaacacugcauggaacagugacaguagaaguccaauaugcaggaacagauggaccauguaaaauaccaguacaaauggccguagacaugcaaacauuaacaccaguaggaagacucauaacagcaaacccugucauuacagaaagcacagaaaauucuaaaaugaugcuagaauuagauccaccuuuuggagauucuuauaucgugauaggaguuggagauaagaaaauaacacaucauuggcauagauccggaaguacaauaggaaaagcguuugaagccacaguaaggggagcaaaaaggauggcaguacucggagauacagcgugggauuuugggucaguuggaggaguuuuuaauagucuaggaaaagguauacaccaaauauuuggggcagcauucaaaucuuuauucggaggaaugagcugguuuucacaaauauuaauaggcacacuacuuguaugguuaggauuaaauaccaaaaauggaucaauaaguuugacaugccuagcgcuaggagggguaaugauauuucugucaacagcaguaagcgcaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9265 - RNA, 2272 nt, Artificial Sequence
  DQ859059.1 prME-short mRNA Design 3 opt
gggagaaagcuuaccaugacaaguauagguauaguaggccuucuacuaacgacagcaauggcagcugaaauaacaagaagagguucagcauauuauauguaucuagauagaagugacgcaggaaaagcuauuagcuucgcaacuacuuuaggaguuaauaaaugucauguacaaauaauggacuuaggacauaugugcgaugcaacaaugaguuaugaaugcccaauguuagaugaaggaguagaaccagacgauguagauugcuggugcaauacuacaucgacauggguaguguacggcacaugucaucacaagaaaggagaagcgagaagaucaagaagggcaguaacacuaccaagccauaguacgagaaaauuacaaacacgaucucaaacaugguuagaaucaagagaauauacaaaacacuuaauaaaagucgagaacuggauauuucggaauccaggauucacccucguugcaguagccauagcuuggcuacuaggauccucaacuagccaaaaaguaauuuauuuaguaaugauauuauuaauagcuccagcauauucaauaagauguauagguguaucuaacagagauuuugucgaaggcaugucaggaggaacauggguagauguaguucuagaacauggaggaugcguaacaguuauggcacaagacaaacccacuguagauauagaauuaguaacgacaacaguaucaaauauggcagaaguacgaagcuauugcuaugaagccucaauaucagacauggcuucagauucaagauguccaacacagggugaagcauaucucgacaaacaaucggacacacaauauguauguaaacgcacauuaguagauagaggaugggguaauggaugcggucuauucggaaaaggaucauuaguaacaugugcaaaauucacuugcucuaagaaaaugacgggaaaaucaauucagccagagaauuuagaauaccguauaauguuaucuguucauggaucacaacauucugggaugauaguaaaugaugaaaauagagcaaaaguagaagugacaccaaauucaccaagagcagaagcuacacuaggaggauuuggaucacuaggauuggauugcgaaccacgaacuggcuuagauuuuucagaucuauacuauuuaacaaugaauaacaaacauuggcuaguacauaaagaaugguuccacgauauaccauuaccauggcaugcuggggcagauacuggaacaccacauuggaauaauaaggaagcauuaguagaauuuaaagaugcucacgcaaaaagacaaacaguagucguguuaggaagucaagaaggagcaguacauaccgcauuagcuggugcacuagaagcagaaauggauggagcaaaaggaagauuauuuucuggacaucuaaaaugccgauuaaagauggauaaacuuagauuaaaagguguuagcuacagucuauguacagcagcauucacauucaccaaaguaccugcagagacccuacacggaacaguuaccguagaaguacaauaugcagggacugauggaccaugcaaaguaccugcacaaauggcaguagacaugcaaacauuaaccccaguaggaagauuaauaacagcuaauccaguaauaacagaaucaacagaaaacagcaaaaugaugcuagaauuggacccaccuuuuggagauaguuacauaguaauaggaguaggagauaagaaaauaacacaucacuggcauaggagugguaguacaauuggaaaagcauuugaagcaacaguuagaggagcuaaaagaauggcagucuuaggagauacagcaugggauuuuggaaguguaggagguguuuuuaauucguuaggaaaaggaauacaucaaauauuuggagccgcuuucaaaagucuuuuuggaggaaugucaugguuuucacaaauucuuauagggacauuauuaguuuggcuuggauuaaacacuaaaaacggaaguauaucuuuaacaugccuagcacuaggagggguaaugauuuuucuaaguacagcaguaagugcaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9266 - RNA, 2278 nt, Artificial Sequence
  KU963573.2 prME-short mRNA Design 3 opt
gggagaaagcuuaccaugacgucaauugguauaauaggccuauuacuaacaacagcuauggcggcagaaauuacaagaaggggaucagcauauuauauguaccuagauagaucagaugcagguaaagcuauaaguuuugcuacuacauugggaguaaauaaaugucacguacaaauaauggaucugggucauaugugcgacgcuacaaugucguaugaauguccaaugcuagacgaaggggucgaaccugaugauguagauuguugguguaauacuacaucgacauggguaguauauggcaccugucaucacaaaaaaggagaagcaagaagaucaagaagggcaguaacacuaccaagucauagcacuagaaaauuacaaacaagaagccaaacaugguuagaaagccgagaauauacaaaacauuuaauaaaaguagagaauuggauauuuagaaauccaggauuugccuuaguagcaguugcaauagcauggcuacuuggaucauccacuagucaaaaaguaauauaucuaguaaugauauuauuaauagcaccagcauauaguauuagauguauaggaguuucaaauagagacuuuguugaagguaugucuggaggaacauggguagacguagucuuagaacauggaggauguguaacaguaauggcacaagauaaaccuacaguagauauagaacuaguaacaacaaccguuaguaauauggcagaaguaaggucauauuguuacgaagcaucaauaucugacauggcaagugauagucgaugcccaacacaaggugaagcguauuuggauaaacaaucagauacacaauauguauguaaaagaacucuaguagauagagguuggggcaacggcuguggauuauuuggaaagggaagccuaguaacaugugcaaaauucacuugcaguaaaaaaaugacaggaaaaucaauacaacccgagaaccuagaauauagaauaauguuaucaguacaugggucgcagcacucaggaaugauaggauaugaaacagaugaaaauagggcuaaaguugagguuacgccaaauucuccacgcgcagaagcaacauuagguggauucggcucacuaggacuagauugugagccaagaacaggauuagacuuuagugaucuauauuaucuaacaaugaauaauaaacauugguuaguacauaaagaaugguuucaugacauaccauuaccauggcacgcaggagcugauacaggcacuccgcauuggaauaauaaagaagcacucguagaguuuaaagacgcacacgccaaacgacaaacagugguuguacuaggaucacaagaaggagcaguucacacagcacuagcaggagcacuagaagccgaaauggauggagcuaaagguaaauuauuuaguggacaucugaaaugcagacuaaaaauggacaaacuuagauugaaagguguaaguuauaguuuaugcaccgcagccuuuacuuuuacaaaaguaccagcagaaacacuucauggcacaguaacaguugaaguacaauaugcugguacagauggaccuuguaaaauuccuguacaaauggcagucgacaugcaaacauuaacaccaguuggacgccuaauaacggcuaauccaguaauaacugaaagcacagagaauaguaaaaugauguuagaauuagaucccccauucggagauaguuacauuguaaucggaguuggagauaaaaaaauaacgcaucauuggcacagaagcgguucaacaauaggaaaagcauuugaagcaacagucagaggugcgaaaagaauggcaguccucggcgauacagcaugggauuucgguucagugggaggaguauucaauucucuagggaaagguauacaucaaauauuuggugcagccuuuaaaucauuauuuggaggaaugaguugguuuucccaaauauuaauuggaacauuauuagugugguuagggcucaacacaaaaaacggaaguauaucacuaacuuguuuagcacuaggaggaguaaugauauuuuugucaacugcuguaagcgcuugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9267 - RNA, 2290 nt, Artificial Sequence
  KX694534.2 prME-short mRNA Design 3 opt
gggagaaagcuuaccaugacaagcguaggaauaguaggucuauuacuaacgacagcaauggcagcagaaguaacuagaagaggaucggcauauuauauguauuuagacagaaaugaugcgggggaagcaauaucuuuuccgacaacauuaggaaugaauaaauguuauauacaaaucauggaccuuggacauaugugugacgcgacaaugucauaugaauguccaauguuggaugaaggaguagaaccagaugauguugauuguugguguaacacgacaucuacauggguaguauauggcacuugccaucauaaaaaaggagaagcgagaagaagcagaagagcagugacacuaccuagucauucaacaagaaaauuacaaacaagaucacaaacaugguuagaaucaagagaauacacaaaacacuuaauucgaguugaaaacuggauauucagaaacccaggauuugccuuagcugcugcagcaauagcaugguuauuaggcaguaguacaagccaaaaaguaauauaucuaguaaugauccuauuaauagccccagcauauaguauaagauguauugguguaucuaaucgagauuuuguagaaggaaugucaggaggaacauggguagacguaguauuagaacacggaggaugugucacaguaauggcacaagacaaaccaacaguagauauugaauuagucacaacuacaguaagcaauauggcagaaguaagaaguuauuguuaugaagccuccauaucagauauggcaagugacucaagauguccgacucaaggagaagcuuaucuugauaaacaaagcgauacucaguacguaugcaaaagaacacuuguugauagaggcuggggaaacggaugcggauuauucggaaaaggaagccugguaacaugcgcuaaauuugcauguaguaaaaaaaugacaggaaaaagcauacaaccagaaaaucuagaauaucgaauaauguuaucaguacacggcucacagcauucaggaaugauuguuaacgacacaggacacgaaacugacgagaauagagcaaaaguugaaauaacaccaaacucaccgagagcagaagcaacauuaggaggcuucggcagccuaggacuagacugugaaccacgaacaggcuuagacuuuagugaucuauauuaccucacuaugaauaacaaacauugguuaguucacaaagaaugguuccaugauauaccuuuaccauggcaugcaggugccgauacugguacaccacacuggaacaacaaagaagcauuaguagaauuuaaagaugcacaugcaaaaagacaaacaguuguuguauuaggaucacaagaaggagcaguacacacagcguuagcaggggcacuagaagcagaaauggacggggccaaaggacggcuaaguucaggacauuuaaaauguagauuaaaaauggauaaauuaagacuaaaaggaguaucguacucgcugugcacagcagccuuuacauucacaaaaauuccugccgaaacacuacacggaacuguaacaguagagguacaauacgcagguacugauggaccauguaaaguaccagcgcaaauggcaguagauaugcaaacauugacaccaguaggaagauuaauaacagcaaauccaguaauaacagaaucuacagaaaacucaaaaaugaugcuugaauuagauccaccuuuuggagauaguuacauaguaauagggguaggagaaaaaaagauaacccaccauuggcauagaucaggaucaaccauagggaaagcauuugaagccacugucagaggagcuaaaaggauggcaguuuuaggagacacagcaugggauuucggaagcguggguggcgcacucaauagucuuggacgaggaauacaucaaauauuuggugccgcauucaaaagucuuuuuggaggaaugaguugguuuucucagauacuaauuggaacauuauuaauguggcuaggauuaaauacaaaaaauggaaguauuucauugauguguuuagcacuaggaggaguauuaauauuucuaaguacggcaguaagugcaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9268 - RNA, 2290 nt, Artificial Sequence
  KX369547.1 prME-short mRNA Design 3 opt
gggagaaagcuuaccaugacaagugucggaauagugggauuacuuuuaacaacagcaauggcugcugaaguaacuagaagagguucagcauacuacauguacuuagacagaaaugaugcaggagaagcaauaaguuuuccgacaacauugggaaugaauaaauguuauauacaaauaauggauuuaggacauaugugugaugcaacaaugucauaugaaugucccauguuagacgaaggcguagaaccagaugauguggauugcuggugcaauacaacaucaacuuggguagucuacggaacaugucaucacaagaaaggugaagcaagaagaagcagacgagcaguaacauuaccuagucauagcacuagaaaguuacaaacacggagucaaacuugguuagagaguagggaauauacaaagcauuuaauaagaguagaaaacuggauauucagaaauccaggucuagcucuagcugcagcugcaauugcauggcuauuaggaucaaguaccucacaaaaagugauauauuuaguaaugauuuuacuaaucgcaccagcauauucaauaagaugcauaggaguuagcaaucgagauuucguagaaggaaugaguggaggaacauggguagauguuguauuagaacacgguggauguguuacagugauggcgcaagauaaaccuacaguagauauagaauuaguuacaacaacuguuagcaauauggcggaaguaagaaguuauuguuacgaagccaguauaagugauauggcaucggacaguagaugccccacacaaggugaagcauaucuagauaaacaaucagauacacaauauguuugcaaaagaacauuaguagacagagguuggggaaaugguugcggucuuuuuggaaaagguagucuaguaacaugcgcaaaauucgccuguagcaagaaaaugacagguaaaaguauacagccugaaaacuuagaguauagaauaaugcuaucaguacacgggagccaacacagcggaaugauuguuaacgacacgggacaugaaacagaugaaaacagagcaaaaguagaaauuacaccgaauagcccucgagcagaagccacacuaggugguuuuggaagccuaggauuggacugugaaccaaggacaggucuagauuuuagugaucuauauuacuuaacaaugaacaauaaacauugguuaguacauaaagaaugguuucaugacaucccuuuaccauggcaugcaggagcagauaccggaacuccacauuggaacaauaaagaagcauuaguagaauuuaaagaugcacacgcaaagagacaaacaguaguaguauuaggaagccaagaaggagccguacauacagccuuagcaggcgcguuagaagcagaaauggauggagcaaaggguagauuaaguucgggacauuugaaauguaggcucaaaauggauaaauuacgauugaaaggaguaaguuacucuuuguguacagcagcuuuuacuuuuacaaaaauaccagcagaaacauuacaugguacagucacuguggaaguacaauaugcaggaacagauggaccaugcaaaguaccugcacaaauggcaguagacaugcaaacacuuacaccgguagguagauuaauaacagcuaauccaguaauaaccgaaaguacagaaaacagcaaaaugauguuagaauuagacccgccauuuggagauucauauauaguaauuggaguaggagaaaagaaaauaacacaccauuggcauagaucaggaaguacuauagguaaagcguucgaagcuacaguaagaggagcaaaaagaauggccguguugggcgacacugcaugggacuuuggaucgguuggaggugcacuaaauucauuagguaaaggcauucaccaaauauuuggagcagcauuuaagucauuauuuggaggaaugagcugguuuucacaaauacuaauuggaacguuauuaauguggcuaggauuaaauacuaaaaaugguagcauuaguuuaaugugucuagccuugggaggaguguuaaucuuccuuaguacagcaguuagugcuugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9269 - RNA, 2290 nt, Artificial Sequence
  KX447515.1 prME-short mRNA Design 3 opt
gggagaaagcuuaccaugacaucaguagguaucguaggauuacuauuaacaacagcaauggcagcagaaguuacgagaagagguucagccuacuauauguaucuugauaggaacgaugcaggggaagcuaucaguuuuccuacaacauuaggaaugaacaaaugcuauauucaaauaauggauuuaggacauaugugugacgcuacuaugagcuaugaauguccuaugcuagacgaaggcguagaaccugaugacguagacuguugguguaauacaacaucgaccuggguaguguauggaacgugucaucauaagaaaggagaagcaagaagaagcagacgagcuguaacauuaccaucacauaguacaagaaaauuacaaacacgaucacaaacauggcuagaaaguagagaauauacaaaacauuuaauuagaguugaaaauuggauauuuaggaauccagguuuugcauuggcagcagcugcaauugcguggcugcucggcaguucaacaucacaaaaaguaauauaucuaguaaugauauugcuaauagcuccagcuuauucaauaagaugcauaggaguuucaaauagagacuuuguugaaggcaugaguggaggcacauggguagacguaguauuagaacacggaggaugcgugacuguaauggcacaagauaaaccaacaguagauauugaguugguaacaacaacagugucaaauauggcagaaguaagaaguuauuguuacgaagcuagcauaagugauauggcaucagacagcagauguccuacucaaggcgaagcauaucucgacaaacaaagugauacacaauacguauguaaaaggacacuggucgacagaggguggggaaacggcugugguuuguuuggaaaaggaagucuaguaaccugugcaaaauuugcuuguaguaaaaagaugacgggaaagaguauccaaccagaaaacuuggaauauagaauaauguuauccgugcacgggagucaacauucaggaaugauaguaaacgauacaggacaugaaacagacgaaaauagagcaaaaguggaaauuacuccaaauaguccaagggccgaagcuacucuuggcggauuuggaucauuaggauuagacugcgaaccgaggacaggacuagauuucagugauuuguacuaucuaacaaugaacaacaaacauugguuaguccauaaagaaugguuccaugauauuccauuaccguggcaugcuggugcggauacuggaacaccacauuggaauaauaaagaagcauuaguagaauuuaaagaugcucaugcaaaaagacaaaccguaguaguuuuagguagucaagaaggagcaguacacacagcauuggcgggagcccuagaagcagaaauggauggagcaaaagggagacuaucuucaggacacuugaaauguagauugaaaauggauaaacucagauuaaaagggguaucauauucauuauguacagcugcauucacauuuacaaaaauaccagcugaaacacuacaugguacuguuacgguagaaguacaauaugcaggcacagacggaccuuguaaaguuccagcacaaauggcaguagacaugcaaacauuaacaccuguaggaagauuaauaacagcaaauccagugauaacagaaucaacagaaaauaguaaaaugauguuagaauuagauccaccauuuggcgauucauauauaguaauagguguaggagaaaagaaaaucacccaccauugguauagaagcggaagcacaauagguaaagcauuugaagcaacaguaagaggagcaaaaaggauggccguucuaggagacacugcaugggauuuuggaaguguaggaggagcacuaaacucuuuaggaaaagguauucaucaaauauuuggagcagcauuuaaaucguuauucggaggaaugagcugguuuucacaaaucuuaauaggaacauuacuaauguggcuuggauugaauaccaaaaauggaucgauaucuuuaaugugucuagcacuagggggaguuuuaauauuucuaucaacagcagugagugcaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9270 - RNA, 2290 nt, Artificial Sequence
  KU729218.1 prME-short mRNA Design 3 opt
gggagaaagcuuaccaugacgucuguuggaauaguuggauuauuacuaacaacagcaauggcagcagaaguuacaagaagaggcucagccuauuacauguacuuagauagaaaugacgcaggagaagcuauuagcuuuccgacuacucuaggaaugaauaaaugcuacauacaaauaauggacuuaggacacaugugcgaugcaacaaugaguuacgaauguccaaugcuagacgaggguguugaaccggaugauguagauuguugguguaacaccacaagcacuugggugguauauggaacgugucaccacaaaaaaggagaagcacguagaucacgaagggcaguaacacucccaucacauaguacuagaaaauuacaaacaagaagucaaacgugguuagaaucaagagaauacaccaaacacuuaauuagaguagaaaauuggauauuucgaaauccagguuuugcucuagcagcagcagcaauagcaugguuauuaggaagcucgacaagucaaaaaguaauauauuuaguaaugauacuauuaauagcuccggcuuauucaauaagauguauaggaguaucaaauagagacuuuguagaaggaaugucuggaggaacuuggguugaugugguauuagaacaugggggauguguaacaguaauggcccaagauaaaccaacaguugauauagaacuuguuacaacaaccguaaguaacauggccgaaguaagauccuauugcuaugaagcaucaauaucggauauggcaagugauucaagauguccuacucaaggagaagccuacuuagacaaacaaagcgauacacaauauguaugcaaaaggacacuaguagaucgugguuggggaaacggauguggauuguucggaaaagguagccucguaacaugugcaaaauuugcuuguaguaaaaaaaugacaggaaaaucaauacaacccgaaaauuuagaauauagaauaaugcuaaguguccacgggagccaacauagcgguaugauaguuaacgauacaggacaugaaacugaugaaaauagggcaaaagucgaaauaacaccaaauaguccaagagcagaagcaacauuagguggauuuggaucuuuaggacuagacugugaaccaaggacugguuuagauuuuagcgacuuauauuaucuaacaaugaacaauaaacauugguuaguacauaaagaaugguuccaugauauaccauuaccauggcacgcaggagcagauaccgguaccccgcacuggaauaauaaagaagcacuaguugaauuuaaagacgcacaugcaaaacgucagacaguaguaguauuaggaagucaagaaggcgcaguacauacagcauuagcaggagcacuugaagcggaaauggauggugcaaaaggaagauuaaguucaggacauuugaagugucgguuaaaaauggacaaacuaagauuaaaaggaguaucauauucgcuauguacagcugcuuuuacauucacuaaaaucccagcugaaacacuacauggaacaguaacaguagaaguucaauaugcagguacugacggaccaugcaaagucccagcacaaauggcaguggauacacagaccuuaacacccgugggaagacuuauuacugcaaauccaguaauaacugaaucaacugaaaauucaaaaaugauguuagaauuagauccaccauuuggagacucguauaucguaauugguguaggagaaaaaaaaauaacucaucacuggcauagaucaggaucaacaauaggaaaagcauucgaagcuacaguaagaggcgcaaaaagaauggcaguccuaggagauacugcaugggacuucggaagcguaggaggcgcacuuaauucucuagguaaaggaauacaucaaauauuuggagcagcauuuaaaagcuuauuuggaggaauguccugguuuucacaaauacuaauaggaacuuuguuaauguggcuuggucuuaauacaaaaaaugggucaauaaguuuaaugugccuagcuuuaggaggggucuuaauauuucuuuccacugcaguaagugcaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9271 - RNA, 2290 nt, Artificial Sequence
  KU501217.1 prME-short mRNA Design 3 opt
gggagaaagcuuaccaugacaucaguuggcauuguaggauuacuauuaacaacagcuauggcagcagaaguaacacgaaggggaucagcauauuauauguaucuagauagaaacgaugcaggagaagcaaucagcuucccaacaacacuagggaugaauaaauguuauauacaaauuauggauuugggccacaugugugacgcaacaaugaguuaugaaugcccaaugcuugacgaaggaguugaacccgaugauguagacugcugguguaauacaaccucaacuuggguaguuuauggaaccugucaucacaagaaaggagaagcucgaagaucaagacgagcaguaacauuaccuagucauucaacgagaaaauuacaaacuagaucacaaacuuggcuugaauccagagaauacacaaaacaucuaauaagaguugaaaacuggaucuuuagaaacccugguuuugccuuagcagcggcugcaauagcaugguuacuaggaucaucaacaagucagaaagucauauauuuagucaugauauuacuaauagcuccugcauacucuauaagauguauaggugugaguaauagagacuuuguggaaggaaugucugguggaacauggguggacguaguuuuagagcacgggggaugcguuacaguaauggcccaagauaaaccaacaguugauauugagcuaguaacaacgaccguaagcaauauggcagaaauaagaucauauugcuaugaagccucaauuagugacauggcuagcgauagcagaugcccaacacagggagaagcauaccuggacaaacaaucagacacacaauauguaugcaaaagaacauuaguagacagaggauggggaaaugguuguggacuauuuggaaaagggucauuaguaacaugcgcaaaauuugcauguucaaagaaaaugaccgguaaaucaauacaaccagaaaauuuagaauacagaauaaugcuaucaguacacgguagucaacauagcgggaugauuguaaacgauacaggacacgaaacagaugaaaaucgcgcaaaaguagaaauaacgccaaauaguccuagagcugaagcaacauuggguggauuugggaguuuaggacuagauugcgaaccuagaacaggacuagauuuuagugacuuauauuaucucacaaugaauaauaaacacugguuaguucacaaagaaugguuucaugauauaccauuaccauggcaugcaggagcagauacagguacaccccauuggaacaauaaagaagcucuaguagaguuuaaagacgcacaugcaaaacgacaaacaguaguaguuuuagguagucaagaaggcgcagugcauacagcacuagcaggagcauuagaagcagaaauggacggugcgaaaggucgauuaaguaguggacauuuaaaaugccgacuaaaaauggacaaauuacgauuaaaagguguaucauacucauuauguaccgcugcauucacuuuuacaaaaauaccugcagaaacauugcacggaacuguaacaguagaaguacaauaugcggguacagauggaccaugcaaaguuccagcccaaauggcuguggauaugcaaacacuaacaccaguagguagacuuauaacggcaaauccaguaauaacagaaaguacagaaaauucaaaaaugauguuagaauuagaucccccauuuggagacagcuauauaguuauaggaguaggagagaaaaagauaacucaucauuggcaucgaagcgguucaacaauuggaaaagcauuugaagcaacuguaagaggagcaaaaagaauggccgucuuaggggacacugcuugggauuucggaucaguaggcggugcauuaaauucacuaggaaaagguauucaccaaauauuuggagcagcauucaaaucauuauucggaggcaugaguugguucagucaaauacuaauaggaacauuacuaauguggcuuggacuaaacacuaaaaaugguucaauaaguuuaaugugucuugcauuaggcggcguacuuauauuuuuaucaacagcaguaucagcaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9272 - RNA, 2290 nt, Artificial Sequence
  KU312314.1 prME-short mRNA Design 3 opt
gggagaaagcuuaccaugaccucaguagguauaguuggauuacuacuaacaaccgcaauggcugcagaaguaacaagaagaggaucagcauauuauauguauuuagacagaaacgaugcaggggaagcgauaucuuuuccaacaacuuuagggaugaauaaauguuacauacaaauaauggaccuaggucacaugugugaugcaacuaugucauaugaaugcccaaugcucgaugaaggaguagaaccagacgacguagacuguugguguaauacaacuucaacauggguaguauauggcacaugccaucauaagaaaggagaagcaagaagaucacguagagcaguaacauugccaucacauucuaccagaaaacuacaaacaagaagccaaacaugguuagaaucaagagaauacacaaaacacuuaauaagaguagaaaauuggauuuuuagaaacccagguuucgcuuuagcugcagcagcuauagcuuggcuauuagggaguagcacaucacaaaaagucauauaucuaguuaugauccuccugauagcaccagcauauaguauacgauguauaggaguaucaaacagggacuucguugaaggaaugaguggaggaacuuggguagauguuguucuagagcauggaggcuguguaacuguaauggcacaagacaaaccaacaguagacauagagcuaguaacaacuacuguaagcaauauggcugaaguaagaucuuauugcuaugaagcaagcauaucagauauggcaagugacagucgauguccaacccaaggagaggcuuauuuagauaaacaauccgauacucaauauguuuguaaacgaacccuaguggacagaggaugggguaacggauguggacuauuugggaaaggaagccucgugacaugugcaaaauuugcuuguucgaaaaagaugacaggaaaaucaauacaaccugaaaaucuagaauauagaauaaugcuaucuguacacggaagccaacauaguggaaugauaguaaaugacacaggucaugaaacagacgagaacagagcaaaaguugaaauuacgcccaauagcccucgagcagaagcuacacuagggggauuugguucucuaggacuagacugugaaccaagaacaggccuagauuuuucagaccuauauuauuuaacaaugaauaauaaacacuggcuaguccauaaagaaugguuccacgauauaccauuacccuggcacgccggagcagacacaggaacaccucacuggaauaauaaagaagcccuuguagaauuuaaagaugcacacgcaaaacgucaaaccguaguaguauuaggcagucaagaaggagcaguucauacagcauuagcuggagcauuagaagcagaaauggacggagcaaagggcagacuauccucaggacaucuaaaaugcagauugaaaauggauaaacuacgauuaaaaggaguaaguuauucacuguguacagcagcauuuacguuuacaaaaauaccagcagaaacauuacacggaacagucacaguagaaguucaauaugcaggaacagacgguccauguaaaguauuagcacaaauggcuguagauaugcaaacacuaacaccuguaggaagauuaauuacugcaaauccuguuaucacugaaagcacagaaaacucaaaaaugaugcuugaauuagauccaccauuuggcgauucauacaucgucauuggaguaggagaaaagaaaauaacgcaucacuggcaccgaaguggaucaacaauagguaaagcauuugaagcaacaguacguggagcuaaaagaauggcaguuuuaggagauacagcuugggauuuuggaagugucgguggagcacuaaacucacuaggaaaaggaauacaucaaauauuuggagcagcauucaaaucauuauuuggaggcaugucaugguuuagucaaauuuuaauaggaacucuacuaaugugguuaggauuaaacacuaaaaacgguucaauauccuuaaugugucuagccuuaggaggaguucuuauauuucucagcacagcuguaagugcuugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9273 - RNA, 2290 nt, Artificial Sequence
  KX446950.2 prME-short mRNA Design 3 opt
gggagaaagcuuaccaugacgaguguaggaauaguaggauuguugcuaacaacagcuauggcugcagaaguaacuagaagaggcagugccuacuacauguacuuagacagaaaugacgcuggugaagcaauuagcuuuccaacaacacuaggaaugaacaaauguuauauacaaauaauggacuuaggccauaugugugaugcaaccaugucauacgaguguccaacauuagacgagggcguugaaccagacgacguagauugcugguguaauaccacuucaacauggguaguauaugguacuugucaccauaagaaaggugaagcaagaagaucacguagagcagugaccuuaccuucacauucuacaagaaaauuacaaacaaggagucaaacauggcuugaaucaagagaguauacaaaacaccuaauaaggguugaaaauuggauauuucgaaacccgggguuugcacuagccgcagcugcaauagcauggcuccuaggaaguucaacuagccaaaaaguaauauaccuaguaaugaucuugcuuauagccccagcauacaguauaagauguauuggagugaguaauagagauuucguagaaggaaugucaggagggacuuggguugauguaguauuagaacauggaggaugcguaaccguaauggcacaagauaaaccgacgguugauauagaauuaguaaccacaacaguaaguaauauggcugagguaagaaguuacuguuaugaggcaucaauaucagacauggccagcgacagucguuguccaacgcaaggagaagccuauuuagacaaacaaucagauacacaauauguauguaaaagaacucuaguugauagaggauggggaaacggcugcggacuuuuuggaaaaggaucauuagugacaugcgcaaaauuugccuguaguaagaaaaugacagguaaaucuauacaaccugaaaauuuagaauauagaauuauguuaucaguacacggaucacaacauucggggaugauaguaaaugauaccggacacgaaacagaugaaaauagagcuaaaguugaaaucacaccaaacaguccaagagcagaagcaacauuaggcggauucggaucacuaggccuagauugugaaccaagaacaggacuagauuuuagcgaucuuuauuacuuaacaaugaauaauaaacauugguuaguucauaaagaaugguuucaugauauaccccuuccauggcaugccggagcagauacuggaacaccacacuggaauaacaaagaagcauuagucgaauuuaaggaugcacaugcaaaaagacaaacuguuguaguauuaggaucacaagaaggagcaguacauacagcuuuagcuggagcacuagaagcugaaauggacggagcaaaaggacgauuaagcucuggacaccuaaaauguagacuaaaaauggauaaacuaagacucaaaggaguuucuuauucguuauguacugcagcauuuacuuuuacaaaaauuccagcagaaacgcuacauggaacaguaacuguagaaguacaauaugccggaacugauggaccauguaaagucccagcacaaauggcaguugauaugcaaacacuaacuccaguaggaagauuaauaaccgcuaauccagucauaacagaaucaacagaaaauucaaaaaugauguuagaauuggauccucccuuuggugacaguuacauaguaauaggaguaggagaaaagaaaauaacacaucacuggcauagaaguggaucaacuauagguaaagcauuugaagcuacaguacgaggagcaaaaagaauggccguucuuggagacacagcuugggacuuuggaaguguaggaggagcucuaaauagcuuaggaaaggguauacaucaaauauuuggagccgcuuuuaaaagucuauucggaggaaugucaugguuuucacaaauauuaauaggaacacuacuaaugugguuaggacuaaauacgaaaaauggcagcauuagcuuaauguguuuagcacuaggaggaguucuaauauucuuaucaacagccguaagugcaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9274 - RNA, 2290 nt, Artificial Sequence
  KY003157.1 prME-short mRNA Design 3 opt
gggagaaagcuuaccaugacaucaguaggaauagugggauuacuuuuaacaacggcaauggcagcugaaguaacaagaagaggcagugcuuauuauauguauuuagacaggaaugaugcaggugaagcaauuaguuuuccuacaacuuuaggcaugaacaaauguuacauacaaauaauggaucuaggacauaugugcgaugcaacaaugucauaugagugcccuauguuagaugaagguguugaaccagacgauguggauugcugguguaauaccaccagcacuuggguaguauacggaacaugucaucauaaaaaaggcgaagcaagaagaaguaggagagcuguaacucucccuagucauucuacgagaaaauuacaaacaagaucacaaacuuggcuugaaucaagagaauauacaaaacauuuaauacgaguagaaaacuggauauuuagaaauccagguuucgcacuggcagcagcagcaauagcaugguuacuaggaucaucaacaagccaaaaaguaauauacuuaguaaugauucuguuaauagcaccagcguauagcauccguuguauagguguaucaaauagagauuuugucgaaggaaugaguggaggaacauggguugauguaguucuagaacacggaggcugcgucacagucauggcacaagauaaaccaacgguagauauugaauuaguaacaacaaccgucagcaacauggcagaaguaagaucauacuguuaugaagcaucaauauccgauauggcaucagacucuagauguccaacucagggagaggcauauuuagauaaacaaucagauacgcaauauguauguaaaagaacauuaguagauagaggguggggcaauggauguggauuauuuggaaagggaucuuuaguuacuugugcaaaauuugcaugcucaaaaaaaaugacaggaaaaaguauucaaccagaaaauuuagaauaccgaauaaugcuuaguguacacggaagucaacauucaggaaugaucgucaaugacacagggcacgaaacagacgaaaacagagcaaaaguagaaauaacaccuaauucuccaagagcagaagcaacuuuagguggauucggaagcuugggccuugauugugaaccaagaaccgggcuugauuuuagcgauuuauacuauuuaacaaugaauaauaaacauugguuaguacauaaagaaugguuccaugauauaccucuaccauggcacgcaggugcagauacaggaacaccacacuggaacaauaaagaagccuuaguugaauuuaaagaugcacaugcgaaaagacaaacagucgucguacuaggaagucaagaaggagcaguacauacugcucuugcaggggccuuagaagcagagauggauggagcaaaaggaagauuaucuucgggacaucucaaauguagauuaaaaauggauaaauuaagacuaaaaggugucuccuacagucuauguacggcagcauucacauuuacaaaaauaccugcagaaaccuuacauggaacaguaacagucgaaguacaauaugcaggaacagaugguccauguaaaguaccagcacaaauggcaguugauaugcagacauuaacacccguaggaagauuaauaacagcaaauccagucauaacugaaucaacagaaaacaguaaaaugauguuagaauuagauccgccauucggagauaguuauauaguuauuggagucggugaaaaaaaaauaacucaccauuggcacagaucaggaucaacaauaggaaaagcauuugaagcaacaguaagaggagcaaaaagaauggcaguguuaggagauacugcaugggauuuuggaaguguaggaggagccuugaauucauuagguaaagguauacaccaaauauuuggggccgcauuuaaaagcuuauuuggaggaaugaguugguuuucacaaauucuaauaggaacauuauuaauguggcuuggauuaaauacuaaaaacgguucuauuucacuaauguguuuagcauuaggcgggguucuaauauuucuuucuacggucguuucagcaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9275 - RNA, 2290 nt, Artificial Sequence
  KX811222.1 prME-short mRNA Design 3 opt
gggagaaagcuuaccaugacaucaguugguauaguuggacuacuauuaacaacagcgauggcagcugaaguaacaagaagaggaucagcauauuacauguacuuagauaggaacgaugcuggugaagcaauuucauuuccuacaacacuaggaaugaauaaauguuauauacaaauaauggaccuaggucauaugugcgaugcuacuaugucuuaugaaugcccaaugcuagaugaaggaguagaaccagaugauguagacuguugguguaacacaaccagugcauggguaguauaugguaccugccaucacaagaaaggagaagcuagaagaucuagacgagcuguaacauuaccuagccauucaacgagaaaauuacagacaagaccacaaacuuggcuagaaucuagagaauacaccaaacaucuaauaaggguagaaaauuggauauuuagaaauccagguuuugcacuagcugccgcagcaauugcuugguuacuagguucaucaacaucucaaaaaguaaucuaucuaguuaugaucuuacuaauagcuccugcauauaguauaagaugcauaggaguaagcaacagagauuuuguagaagguaugucagguggaacauggguugauguaguacuugaacacgguggaugugugacuguaauggcacaggauaaacccacaguggacauagaauuaguaacaacaacugugucaaauauggcugaaguaagaucauacugcuaugaagcaucaauuagugauauggcauccgauaguagauguccuacacaaggagaagcauaucuagauaaacaaagugacacacaauaugucuguaaaagaacguuaguugauagaggauggggaaauggaugcggauuauuuggaaaaggaucacuuguaaccugugcaaaauuugcauguucaaagaaaaugacaggcaaaaguauacaaccagaaaaucuagaauauagaauaauguuaucgguccauggaucacaacauagcgguaugauuguaaaugauacaggacacgaaacagacgaaaauagggcaaaaguugaaaucaccccaaacucacccagagcagaagcaacucugggaggauuuggcagccugggauuagauugugaaccaagaacuggacuugauuuuagugaucuauacuaucuuacaaugaacaauaaacauuggcucguacauaaagaaugguuccaugauauaccauuaccuuggcaugcaggagccgauacaggaacaccacacuggaacaauaaagaagcauuaguagaguucaaagacgcacaugcaaaaaggcaaacaguaguuguacuaggaagccaagaaggagcaguucauacugcauuagcgggugcauuagaagccgaaauggauggagcgaaagguagauuaucuucuggacacuugaaaugucgcuuaaaaauggauaaacuaagacuaaaaggaguaaguuacucauuaugcacagcagcauucacauuuacaaaaauuccugcggaaacacuacacggaacuguaacaguagaaguacaauaugcuggaacugauggaccauguaaaguucccgcacaaauggcaguugacaugcaaacauuaacaccgguaggaagauugauuacugcgaacccuguuauaacagaaaguacggaaaauaguaaaaugaugcuagaauuagauccaccuuuuggagauaguuauauaguaauaggaguaggugaaaagaaaauaacacaucauuggcacagaagcggaucaacaauaggaaaagcauuugaagcuacaguuagaggagcuaaacgaauggccguacuuggagacacagccugggauuuuggcuccguaggaggagcauuaaacagucuagguaaaggcauacaucaaauauuuggagcagccuuuaaaaguuuauuuggagguaugucaugguuuucacaaauacuaauaggaacauuauuaauguggcuaggacuaaacacuaaaaauggaucgauaagccuuaugugcuuagcacuaggagguguuuuaauauuucuaagcacagcagugucagcuugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9276 - RNA, 2290 nt, Artificial Sequence
  KX447516.1 prME-short mRNA Design 3 opt
gggagaaagcuuaccaugacaucugugggaauaguagguuuauuauuaacuaccgcaauggcugccgaaguaacaagaagaggaucagcauauuauauguaccuugauagaaaugaugcaggagaagcaauaucuuuuccaacaacauuagguaugaauaaaugcuacauacaaauuauggauuuaggacauaugugugaugcaacgaugucauaugaauguccaaugcuugaugaaggaguugaaccugacgauguagauuguugguguaauacaacaagcaccuggguuguauauggaacaugucaucauaaaaaaggagaagcucgaagaaguagaagagcaguaacccuaccgagccacagcacuagaaaauuacaaacuaggucacaaaccuggcuagaaaguagagaauacacaaaacaucuuauaagaguagaaaauuggaucuuuagaaauccagguuucgcacuagcagcagcagcaauagcauggcuacuagguucguccacaucaaaaaaaguaauauauuuaguaaugauauuacuaauagcaccagcauauucaauaagauguauagguguaaguaauagagauuucguugaaggaaugaguggaggaacauggguagauguagucuuagaacacggaggaugugugacuguuauggcacaagacaaaccaacaguagacauagaacuuguaacgacaacaguaagcaauauggcagaaguacguaguuauugcuaugaagcaucaauuucagauauggcaucagauuccagauguccaacacaaggagaagcuuauuuagauaaacagucagauacgcaauauguuugcaaacgaacccuaguugacagaggguggggcaacggaugcggauuguucggaaaaggaucguuaguaacuugugccaaauucgcauguucuaaaaaaaugaccggaaaaucaauacaaccagaaaauuuagaauauagaaucaugcuaagcgugcauggcucacaacacucuggcaugauuguaaaugauacaggacaugaaacugacgagaauagagcuaaaguagaaauaacaccgaauucacccagagcagaagcaacauuaggaggauucggaucacugggauuagauugcgaaccacgaacaggauuagauuucagugaccuuuauuauuuaacaaugaauaauaaacauugguuaguacauaaagaaugguuccacgacauaccauuaccuuggcaugcaggcgccgauacaggaacaccacauuggaauaauaaagaagcucuaguagaauuuaaagaugcacaugcaaaaaggcaaacaguagucguucuaggaucacaagaaggagcaguacauacagcauuagcaggagccuuagaagccgaaauggauggcgcaaaaggaagacuaagcagcggacauuugaaaugucgguuaaagauggacaaguuaagguuaaaaggcguuagcuacaguuuauguacagcagcauuuaccuucacaaaaaucccugccgaaacauuacauggaacaguuacaguagaaguucaauaugccgggacugacggaccauguaaaguaccagcucaaauggcaguagacaugcaaacauuaacaccuguuggaagacuaauaacagcaaauccagugauaacugagaguacagaaaacaguaaaaugauguuagaauuggacccuccauucggugacagcuauaucguaauaggaguaggugaaaaaaaaauaacacaucacuggcacagaucaggaucaacaauagguaaagcauucgaagcaacaguacguggagcaaaacgaauggcgguucuaggagauacugcgugggauuucggaagcgucggaggggcauuaaacucauuagggaaaggaauucaucaaauauuuggugccgcauuuaaaagccuauuuggagguaugaguugguuuagucaaauauuaauuggaacacuccuuauguggcucggauuaaauacuaaaaacggaucuauuaguuuaauguguuuggcauuaggugguguacuuauauuuuuaaguacagcaguaucagcaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9277 - RNA, 2290 nt, Artificial Sequence
  KX520666.1 prME-short mRNA Design 3 opt
gggagaaagcuuaccaugacgaguguagguauaguaggauuauuacuaaccacagcuauggccgcagaaguaaccagaagaggaagugcauacuauauguacuuagaucggaaugaugcaggggaagccauaagcuuuccaacaacucuagguaugaauaaaugcuauauacaaauaauggacuuaggacauaugugugaugcgacaaugagcuaugaauguccaaugcuagacgaaggcguagaaccagaugauguugacugcugguguaacacaacaaguacauggguaguauacgggacaugucaccauaaaaaaggcgaagcgcgaagaucaagaagagcaguuacauuaccaagucauuccacuagaaaauuacaaacccguucacaaacauggcuugaaucacgagaauacacaaaacaucuuauucguguagaaaacuggauauuccgaaauccgggauuugcacuagcagcagcagcaaucgcaugguuauuaggaaguucuacaagacaaaaaguuauauaccucguaaugauacuuuuaauagcaccagccuauagcauaagauguauaggaguauccaacagagauuucguugaaggaaugaguggaggaacauggguagacguagucuuagaacauggaggauguguaacaguaauggcucaagauaaaccuacaguugauauagaacucguaacaacuacaguaaguaauauggccgaaguccguucauauuguuaugaagcaucaauaucagauauggcgagcgacaguagauguccuacccaaggagaagcauauuuagacaaacaaagugauacacaauaugucugcaaaagaacauuaguggacagagguugggguaauggaugcggacuauucggaaaaggaaguuuaguaacaugugccaaauuugccuguucaaagaaaaugacaggaaaaucaauacaaccagaaaacuuagaauauagaauuauguuaucaguccauggcucacaacacagugggaugauagucaacgacacaggacaugaaacagaugaaaauagagcuaaaguagaaauuacaccaaauucaccccgagcggaagcaacacuaggaggauuuggaucacuaggauuagauugugaaccuagaacagguuuagacuuuagugauuuauacuaucuuacaaugaacaauaaacacugguuaguacacaaagagugguuccaugacauaccacuuccauggcaugcaggagcagacacggggacgccacauuggaauaauaaagaagcauuaguagaauuuaaagaugcacaugcgaaaagacaaacgguaguaguacuagguagccaagaaggagcaguacacacagccuuagcaggugcauuagaagcagaaauggacggagcuaaaggacgguuaucaagugggcacuuaaaaugcagacuaaaaauggacaaauuaagauuaaaaggaguaagcuacucauuaugcacagcagcauuuacauucacuaaaauccccgcagagacuuuacauggcacagugaccguagaaguacaauacgcaggcacagauggaccauguaaaguuccugcacaaauggcuguagauaugcaaacguuaacaccaguugguagauuaauaacugcaaauccuguaauuaccgaguccacggaaaauucaaaaaugaugcuagaauuagacccaccauuuggagauucuuauauaguaauaggagucggagagaagaaaauaacucaucauuggcauagaagcggaaguacaauaggaaaagcauuugaagcaacagucagaggagccaaaagaauggcaguucuaggagacaccgcuugggauuuuggaucaguaggaggugccuuaaauucucuaggaaaaggaauacaucagauauuuggugcagcauuuaaaaguuuauucgguggaaugucgugguuuucacagaucuuaauaggaacgcugcuaauguggcuaggacuaaauacaaaaaauggaucaauaucauuaaugugucuagcauuagguggcguacuaauauuuuuaucaacagcaguaucagcaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9278 - RNA, 2290 nt, Artificial Sequence
  KU497555.1 prME-short mRNA Design 3 opt
gggagaaagcuuaccaugacaagugucggcauaguaggucucuuacugacaacagcgauggcagcagaaguaacaagaagaggcagugcauacuacauguauuuagauaggaaugaugccggggaagcaauaucauucccaacaacuuuagguaugaauaaauguuauauacaaauaauggauuuggggcauaugugugacgcuaccaugaguuacgaauguccaaugcuugaugaaggugucgaaccagaugauguagauuguugguguaauacaacuaguacauggguaguuuauggaacuugucaucacaaaaaaggagaagcgagaagaagcagaagagcugugacacuccccucccauaguacuagaaaacuacaaacacgaagccaaacaugguuagaaucaagagaauauacaaaacauuuaauaagaguagaaaauuggauuuuuagaaauccaggauuugcauuagcugcagcugcaauagcauggcuccuggguucaucaacuagucagaaagugauuuauuuaguuaugauacuacuaaucgcacccgcguauucaauaagguguauagguguauccaacagagauuucguagaaggaaugucuggaggaacauggguugauguaguuuuagaacacgguggguguguuacaguaauggcucaagacaaaccaacuguagauauugaacuaguaacaacuacuguaagcaauauggcagaagucagaaguuauuguuacgaagccucaauaagcgacauggcuucagauucuagauguccaacacaaggggaagcauauuuagauaaacaaucagauacacaauaugucugcaaaagaacacuagucgacagaggaugggggaacgguugcggguuauucggcaaaggaucauuaguuaccugcgcaaaauucgcauguagcaaaaaaaugacggguaaaaguauacaaccagaaaaucuugaauauagaauaaugcuaucuguucacgguucacaacauaguggaaugauagucaaugauacaggacaugaaaccgaugaaaacagagcaaaaguugaaaucacaccaaauucaccucgagcagaggcuacauuaggaggcuuugguagucuuggauuagacugugaaccgagaacaggauuagauuuuagugauuuauauuauuuaacaaugaauaauaaacauuggcugguacacaaagaaugguuucaugauauuccacuuccauggcacgcaggugcagauacagguacaccgcacuggaauaacaaagaagcauuagucgaauuuaaagacgcacaugcaaaaagacaaacaguaguuguuuuaggcacucaagaaggugcaguccauacggcacuagcgggggcacuagaagcagaaauggauggugcuaaaggaagacuaaguucaggacauuuaaaauguagauuaaaaauggauaaauuaagacuaaaaggaguaucauauucauuauguacagcagcauuuacauuuacgaaaauuccagccgaaacccuacacgguacuguuacuguagaaguccaauaugcagguacagauggaccauguaaaguaccugcgcaaauggcaguagauaugcaaacacuuacaccaguaggaagauuaauaacugcgaauccaguaauaacggaauccacagaaaauucaaagaugauguuagaauuagauccaccuuuuggagauucauacauaguaaucggaguuggugaaaaaaaaauaacacaucauuggcauagaucaggcucaacaauaggaaaagccuuugaggcaacaguaagaggcgccaaaagaauggcaguccuaggugacacagcaugggauuuuggaucuguaggaggagcauuaaauucccuaggaaaaggaauacaccaaauuuuuggagccgcuuuuaaauccuuauuuggaggaaugucaugguuuucacaaauucuaauuggaacacuauugaugugguuaggcuuaaacacaaaaaacggaagcaucaguuuaaugugucuggcacucggaggaguacuaauauuccuaucaacagcaguuagcgcaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9279 - RNA, 2290 nt, Artificial Sequence
  KY075939.1 prME-short mRNA Design 3 opt
gggagaaagcuuaccaugacuucuguaggaauaguaggccuauuguuaacaacugccauggccgcagaagucacaagaaggggcagcgcauacuauauguauuuagauagaaacgaugcaggagaggcaauuucauuuccaacaacacuaggaaugaauaaauguuauauacaaauaauggaucuuggucauaugugugacgcaacaaugucguaugaauguccuaugcuugacgaagguguugaaccagaugauguagauuguuggugcaauacaacaucaacuuggguaguauacggaaccugucaucauaaaaaaggagaggcaagaagaucaagaagagcaguuacgcuaccuagucauucgacaaggaaauuacaaacaagaagucaaacauggcuagaaagcagagaauacacuaaacaccuaauaagaguagaaaacuggauauuuagaaauccuggauuugcacuagcagcugcggcaauagcauggcuauugggcucaucaacaagccaaaaaguaauauaucuagucaugauacucuuaauagcaccagcauacagcuuaagauguauaggagucagcaaucgagauuuuguagaggguaugaguggagguacauggguggauguaguucuugaacauggaggguguguaacaguaauggcucaagauaaaccaacaguagauauagaguugguaacgacaacagucagcaauauggcagaaguaagaagcuacuguuacgaagcaucaauaucagauauggcaagugacucaagauguccaacacaaggagaagcauauuuagauaaacaauccgauacucaauauguauguaaacgaacguuaguagacagagguuggggaaauggauguggccuuuuuggaaaagguucacuaguaacuugugccaaauuugcauguucaaaaaaaaugacaggaaaaucaauacaaccagaaaauuuagaauauagaaucaugcuuucaguccauggaagucagcacucaggaaugaucgucaaugauacaggacaugaaacugaugaaaauagagcuaaaguugaaauuacaccgaauuccccaagggcugaagcaacucuuggcggauuugguagucugggucuagacugcgaaccaagaacagguuuagacuuuucagauuuauacuaccuaacaaugaauaauaaacauugguuagugcauaaagaaugguuucacgauauuccauuaccauggcacgcaggugcagauacagguacaccacauuggaauaauaaagaggcacuaguagaauuuaaagaugcacacgcaaaaagacaaacaguaguaguauuagguucacaagaaggagcaguacauacagcuuuagcaggagcauuagaagccgaaauggacggcgccaaaggaagacuuucaagcgggcauuuaaaaugcagauuaaaaauggauaaacuuaggcuaaaaggaguaaguuauaguuuauguacagccgcuuucacauuuacuaaaauaccagcagaaacacuacacgguacaguuacuguugaaguucaauacgcagguacagauggucccuguaaaguaccagcacaaauggcuguagacaugcaaacgcuuaccccaguaggaagauuaauuacugcaaacccaguaauaacagaaucaacagagaacagcaaaaugauguuagaauuagauccaccuuucggugauucauauauaguaauaggaguaggagaaaaaaaaauaacacaucauuggcauagaagugggaguacaauugguaaagcguucgaagcuacuguuagaggagcaaaacgaauggcgguauuaggagauacagccugggauuucggaaguguugguggagcauuaaauaguuuaggcaaaggaauacaucaaauauucggagcugcauuuaagagucuauucggugguaugaguugguucucacaaauacuaauuggaacacuauuaaugugguuaggauuaaauacaaaaaacggaaguauaucacuaauguguuuagcauuagguggaguuuuaauuuuucuaagcacagcaguaucagcuugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9280 - RNA, 2290 nt, Artificial Sequence
  KY075932.1 prME-short mRNA Design 3 opt
gggagaaagcuuaccaugacgaguguuggcauuguaggguuauuauuaacaacggcuauggcagcagaaguaacaagaagaggaucagcauauuauauguauuuagauagaaacgacgcaggagaagcaauaucuuucccaacaacacuagguaugaauaaauguuauauacaaauaauggaucuaggucauaugugugaugcuacaaugagcuaugaaugcccaaugcuagaugaaggaguagaaccggaugacguagacuguugguguaauacaacaucuacauggguaguauacggaacaugucaccauaagaaaggagaagcaagaagaucgcguagagcagucacacuccccucacauucaaccagaaaauuacaaacuagaagucaaacuugguuagaaucaagagaauauacuaaacacuuaauaagaauagaaaacuggauauucagaaauccaggauuugcauuagcugcggcagcuauagcauggcucuuaggaucuucuaccagucaaaaaguaauauaccuaguaaugauacucuuaauagcaccagcauauucuauacgaugcauuggagugaguaacagagauuuuguugaaggaaugucaggaggaacauggguagacguuguucucgaacacggaggauguguaaccgugauggcucaggauaaaccaacaguagauauugaauuaguaacaacaacaguuucaaauauggcagaaguccgaaguuacuguuacgaagcauccauaucagacauggcaucggauucaagauguccaacccaaggagaagccuauuuagauaaacagucagacacucaauauguuuguaaacgaaccuuaguagaucgaggcugggguaauggauguggacuuuucgguaaaggcagucuuguaaccugcgcaaaauucgcauguaguaagaaaaugacaggaaaaaguauccaaccagaaaaccuggaauauagaauuaugcuaucaguccacggaucacaacauucaggaaugauaguaaaugauacuggucaugaaacagaugaaaauagggcaaaaguagaaauaacuccaaauucaccacgagccgaggccacccuuggaggauuuggaucauuaggccuagauugcgaaccuagaacaggauuagauuuuagugauuuauacuauuuaaccaugaacaacaaacauugguuaguucauaaagaaugguuucaugauauaccauuaccauggcaugcuggagcagauacagguacaccacauuggaacaauaaagaagcauuaguugaauuuaaagaugcacacgcuaaacgucaaacuguuguuguuuuaggaucacaggaaggagcuguacauacagcauuagcgggugccuuagaagcagaaauggacggagcaaaaggucgacuaaguaguggucacuuaaaauguagauuaaaaauggacaaauuaagauuaaaagguguuuccuauuccuuauguacagcagcguuuaccuucaccaaaauaccagcagaaacccuacacggaacaguaacaguagaaguacaauaugcagguacagauggacccuguaaaguuccugcacaaauggcaguagacaugcaaacuuuaaccccaguaggaagauuaauaacagccaauccagugauuacagaauccacagaaaacucgaaaaugauguuagaauuggauccaccauucggugauaguuacauaguuauaggaguaggagaaaagaaaauuacacaccauuggcacagaagcggaagcacaauaggaaaagcauucgaagcaacaguaagaggagcaaaaagaauggcugucuuaggagauacagcaugggauuucgguucuguuggcggagcuuugaacaguuugggcaaaggaauacaucaaauauuuggggcagcauuuaagagcuuauuuggagguaugucaugguucucacaaauauuaauaggaacauuacuaauguggcuaggauuaaauacgaaaaauggcagcauuucacuaaugugucuagcauuagguggagucuuaauauuucuaucaacagcaguaucagcuugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9281 - RNA, 2290 nt, Artificial Sequence
  KU870645.1 prME-short mRNA Design 3 opt
gggagaaagcuuaccaugacaucagugggaauugugggauuauuauuaacaaccgcuauggcagcagaagucacuagaagaggaucugcauauuacauguaucuagauagaaacgaugcaggagaagcaauaaguuucccaacaacauuagguaugaauaaauguuacauacagauaauggaucuaggucauaugugcgaugcaacuaugaguuaugaaugcccaauguuagaugaaggaguagaaccagaugauguagauuguugguguaacacaacaucaacauggguagucuacggaacaugucaucauaagaaaggugaagcuagaagaagccgcagggcaguaacuuuaccgucgcacucaacaagaaaacuucagacaagaagucaaacuugguuagaaaguagagaauauacaaaacauuuaauccguguagaaaauuggauauuaaggaacccaggauucgcauuagcagcagcggcaauagccugguuacuagguucaagcacgucacaaaaaguaauauacuuagucaugauacuguuaauugcaccagcauauagcauucguuguauuggcguaucuaacagagauuucguugaaggaaugucgggaggaacauggguugauguaguucuagaacauggcgguuguguaacaguaauggcccaagauaaaccaacaguagauaucgaacucguaacuacaacgguauccaauauggcagaaguucgaaguuauuguuacgaagcaaguauaagugacauggccuccgauucaagauguccuacgcagggugaggcuuaucuagacaaacaaucggacacacaauauguauguaaaagaacauuaguagauagaggauggggaaauggauguggacuauuuggaaaaggaaguuuaguaaccugugcaaaauuugcuugcaguaagaaaaugacagguaaaagcauacaaccagaaaaucuugaauauagaauaaugcugagcguacacggcagccaacacucuggaaugauuguaaacgauacugggcaugaaacagaugaaaaucgagcaaaaguagaaauaacaccaaacagcccaagggcugaagcaacccuggguggauuuggaaguuugggucuagauugcgaaccaagaaccggucuagauuucucagauuuauauuauuuaacgaugaauaauaaacauugguuaguacauaaagaaugguuccaugauauaccauuaccauggcaugcaggagcugauacaggaacaccacauuggaauaacaaagaagcauuaguagaguucaaagaugcacacgcaaaaagacaaacuguaguaguacuaggaagucaagaaggagcaguccacacagcauuagcaggagcucuagaagcagaaauggauggugcaaaaggccgacuaucuucuggacauuuaaaauguagauuaaaaauggacaaacuaagauuaaaaggagugucauacucauuaugcacagcagcauuuacauuuacaaaaauuccagcagaaacacuacauggaacaguaacuguagaaguccaauaugccggaacagacggaccuuguaaaguaccagcacaaauggccguagauaugcaaacauuaacaccuguagguagacuaauuacagccaauccaguaauaacugaauccacugaaaauagcaaaaugaugcuagaacuggauccuccauuuggagauucauauauagucauagggauaggagagaaaaagauaacacaccacuggcauagaucuggaaguacuauagguaaagcauucgaagcaacaguaagaggugcaaaaaggauggcaguauuaggagacacagccugggauuucggaucaguaggaggugcauuaaauucauuaggaaaagguauccaccaaauuuucggagcagcuuuuaaaucuuuauucgguggaaugaguugguuuucacaaauauuaauuggaacuuuacuaauguggcuaggauuaaauaccaaaaauggaucaauaagucuuaugugucuagcauuagguggaguacuuauauuucuaaguacagcaguaucagcuugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9282 - RNA, 2290 nt, Artificial Sequence
  KU729217.2 prME-short mRNA Design 3 opt
gggagaaagcuuaccaugacuucaguaggaaucgucggacuuuuguuaacaacggccauggcugcagagguaacaagaagaggaucagcuuauuacauguauuuagauaggaaugaugcuggagaagccauaaguuucccaacuacacuaggaaugaauaaauguuauauucaaauaauggauuuaggucauaugugugacgccacuaugaguuacgaguguccaauguuggaugaaggcguagaaccagacgauguugacuguuggugcaacaccacaucaacauggguaguauaugguacaugucaucauaagaaaggagaagcaagaagaucaagaagggcaguaacacucccuucacauucaacaagaaaauuacaaacgagaagccagacauggcuagagucaagagaauauacuaaacacuuaauaagaguagaaaauuggauauucagaaauccaggguuugcauuagcagcagcagcaauagcuugguuacuaggaaguaguacgucacaaaaaguaauauaucuuguaaugauuuuauuaauugcaccagcuuauagcauuagauguauaggcguuuccaaccgugauuuuguugaaggaaugucuggaggaacauggguugauguagugcuagaacacggaggauguguaacaguuauggcacaagauaaaccaacaguggacauagagcuaguaucaacuacugucagcaauauggcggaaguaagaucauacuguuacgaagccacaauaagugauauagcaucagacucaagaugcccaacacaaggagaagcauaucuagacaaacaaucagacacucaauauguauguaaaagaacauugguagauagaggauggggaaauggaugcggauuauuuggaaaaggcaguuuaguuacaugugcaaaauuugccugcaguaagaaaaugacuggaaaaucaauacaaccugaaaauuuagaauauagaauaauguuaucaguacaugggucucagcacucaggaaugauagucaaugacacaggacacgaaacugaugaaaauagagcuaaaguugaaauaacaccaaauagcccacgagcagaagcaacauuaggaggcuuuggaaguuuaggacuagauugugaaccaagaacaggccuagacuuuucagaucuauauuauuuaacaaugaacaacaaacauuggcuaguacacaaagaaugguuccacgauauaccauugccauggcacgcaggagcagacacaggaacuccacauuggaauaauaaagaagcucuuguagaauuuaaagaugcacaugcaaaaagacaaacagccguaguacuagguucacaagaaggagcuguacacacagcacuagcuggagcauuagaggcagaaauggauggagcuaaaggaagauugucgagugggcaucuaaaaugcagauuaaaaauggacaaauuacgauuaaaaggaguaucuuauucacuaugcaccgccgcauuuacauuuacaaaaauaccggcagaaaccuuacauggaaccguaacaguugaaguacaauaugcaggaacagaugguccauguaaaguaccagcucaaauggcaguugauaugcaaacauuaacaccagucggaagacuuauaacagcaaauccaguaauaacagaauccacagaaaauagcaaaaugaugcuggaacuagauccuccauuuggggacucauacaucguaauaggaguaggagaaaagaaaauaacgcaccauuggcauagaagugguaguacaauaggaaaagcauucgaagcuacaguaagaggagcgaaaagaauggcaguauuaggugacacugcuugggauuuuggaucagucggcggggcauuaaauucauuagguaaaggaauacaucagauuuuuggagcagccuuuaaaucauuauuuggugggaugaguugguuuucacaaauauuaauaggaaccuuacuuaugugguuaggcuuaaauacuaaaaaugguagcauaucacuuaugugcuuagcauuagguggagucuuaauauuuuuaucuacagcagucagcgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9283 - RNA, 2290 nt, Artificial Sequence
  KX087101.3 prME-short mRNA Design 3 opt
gggagaaagcuuaccaugacaagcguagguauaguugguuuacuuuuaacaacagcaauggcagcagaaguaacuagaagaggaagugcauauuauauguaccuagaucguaacgacgcgggugaagcaaucagcuuucccaccacuuuaggaaugaauaaauguuacauacaaauaauggacuuaggacauaugugugaugcaacaaugaguuaugaauguccaaugcuagaugagggaguugaaccagaugaugucgacuguugguguaauacaacaaguacuuggguuguauaugggacuugucaucauaagaaaggugaagcuaggagaucaagacgcgcagugacacuaccuagucauagcacuagaaaacuccaaacacgaucacaaacaugguuagaaucacgcgaauacacaaaacacuugauacguguagaaaacuggauauuucguaacccagguuucgcacuggcagcagcagcaauagcauggcuauuaggaaguagcacuucacaaaaagucauauaucuagucaugaucuuauuaauagcaccagcauauaguauaagaugcauagggguaucaaacagagauuucguagaaggaaugaguggaggaacauggguagacguaguacuggaacacggaggaugcguaacuguaauggcacaagacaaaccuacaguagauauagaguuaguaacgacuacaguuaguaacauggcagaaguuagaaguuauuguuaugaagcaaguauaagugauauggcaagcgauaguagaugcccaacccaaggagaagcauauuuagauaaacagagcgacacucaauauguuuguaaaagaacuuuaguagacaggggaugggggaacggauguggacuauuuggaaaaggauccuugguuacaugugcaaaauuugcauguucaaagaaaaugacaggaaaaucaauccagccugaaaaccuugaauacagaaucaugcuaagcguacaugggucacaacacucaggaaugauaguaaacgauacgggacaugaaacagaugaaaacagagcaaaaguggaaauaaccccaaauagcccacgagcagaagcaacucuuggagguuuuggaucucuaggauuagauugugaaccccgaacuggucuagauuuuagugacuuauauuaucucacuaugaauaacaaacacugguuaguacauaaagaaugguuccaugauauaccacuacccuggcaugcuggagcagacacgggaacaccacauuggaauaauaaagaagcucuaguagaauuuaaagaugcacacgcaaaaagacagacaguagugguauuaggaucacaagaaggugcaguacauacagcacuugcaggagcccuagaagcagaaauggacggagcaaaaggccgacuaaguaguggacaucuaaaauguagauuaaaaauggacaaauuaagacuaaaaggaguaucuuauucauuauguacagcggcauuuacauuuacuaaaauacccgcugaaacacuacacggaaccguaacaguagaacuacaauaugcagguacagaugguccauguaaaguaccugcccaaauggcuguagauaugcaaacguuaacaccaguuggaagguuaauaaccgcaaacccaguaauaacagaaucaacggaaaacagcaaaaugauguuagaauuagacccaccauuuggugacucauauauaguaaucggaguaggagaaaagaaaauaacacaucacuggcauagaaguggaaguacuauaggaaaagcauuugaagcaacaguaagaggagcaaaaagaauggccguauuaggagauacugcuugggauuuugguucaguagguggagcacuaaacagucuaggaaaaggaauacaccaaauauuuggugcagcauuuaaaagucuauucggcggaaugucgugguuuucacaaauacuaauagguacacuauuaauguggcuuggacuuaauacuaaaaauggaagcaucagcuuaauguguuuagcauuaggaggcguccuaauauucuuaaguacagcaguaagugcuugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9284 - RNA, 2290 nt, Artificial Sequence
  KY014317.1 prME-short mRNA Design 3 opt
gggagaaagcuuaccaugacaagcguaggcauaguaggauuacuauuaacaacagcaauggcugcagaaguaacaaggcgaggaagugcauauuauauguauuuagauagaaaugacgcaggcgaagcaauaaguuuuccaacaacauuaggaaugaacaaauguuacauacaaauaauggauuuaggacauaugugugacgcaacaaugucauaugaauguccaauguuagaugaaggaguggaaccagaugauguagacuguuggugcaauacuacaaguacguggguaguauacggaacgugccaucauaaaaaaggagaagcccgaagaagccgaagagcuguaacucuacccagccauucuacccgcaaauuacaaaccagaucacaaaccugguuagaaucaagagaauauacaaaacacuuaauuagaguugagaauuggaucuuuagaaaucccgguuuugcauuagcagcagcggcaaucgcauggcuauuaggaucuucaacaucacaaaaaguaauauacuuaguaaugauauuauuaauagcuccagcauacaguauaagauguauaggaguaucaaauagagauuucguugaaggaaugucuggaggaacauggguagauguaguacuagaacacggcggauguguuacaguaauggcacaagauaaaccuacaguagauauagagcucgucacaacuaccguuucaaauauggcagaaguaaggucauauugcuacgaagcaagcaucagugauauggcaagcgauucaagauguccaacucaaggagaagcauaucuagacaaacaaucagacacacaauauguaugcaaaagaacacuuguagacaggggaugggguaaugggugcggccuauucgguaaagguucgcuaguaacaugcgcgaaauuugcaugcaguaaaaaaaugacagguaaaaguauucaaccagaaaacuuagaauauaggauaaugcuaucuguucauggaucacaacacagcggaaugauaguaaaugauacuggacacgaaacagaugaaaaccgagcaaaaguagaaauaacaccaaauagcccaagagcugaagcaacucuagguggauuugguucacuagguuuggacugugaaccaagaacaggacuggauuuuucagaucuauauuauuugaccaugaacaacaaacauuggcuuguacauaaagaaugguuccaugauaucccauuaccauggcaugcaggcgcggauacaggaacaccacauuggaauaacaaagaagcacuaguggaguucaaagacgcacacgcaaaaagacagacaguaguaguacuaggaucacaagaaggagcaguucauacagcuuuagccggcgcuuuggaagcagaaauggauggagcaaaagguagacuuaguuccggccaucuuaaaugucgacugaaaauggauaaacuacgacuaaaaggagugucauauucacucuguacagcagcauuuacuuucacuaaaauaccagcagaaacauuacauggaacuguaacaguagagguacaauaugcuggcacagacggcccauguaaaguaccagcacaaauggcugucgauaugcagaccuuaacuccuguugguagacuaauaaccgcaaauccaguaauuacagaaaguauagaaaauagcaaaaugaugcuugaacuagauccaccauuuggugauucguauauaguuauagggguuggagaaaaaaaaauaacucaucauuggcauagaucaggaucaacuauaggaaaagcauuugaagcuacaguaagaggagcaaaaaggauggcaguuuuaggugacacagcaugggauuuugguucuguaggaggagcauuaaacucccuagguaaaggaauacaucaaauauuuggugcagccuuuaaaagccuauuuggagguaugucuugguuuucacaaauauuaauaggaacacuucuaauguggcuaggacuaaacacuaagaauggaaguaucagcuuaauguguuuagcacucggaggaguacuaauauuuuuaucaacagcaguguccgcaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9285 - RNA, 2290 nt, Artificial Sequence
  KU758876.1 prME-short mRNA Design 3 opt
gggagaaagcuuaccaugacaucaguuggaauaguaggucuauuacuaacaacagcaauggcugcagaaguaacucggcguggaagcgcuuauuacauguacuuagacagaaaugaugcaggcgaagcaauaucauuuccaacaacacuaggcaugaauaaaugcuacauacaaauaauggauuuagggcauaugugugaugcaacuaugucuuacgaauguccaauguuagaugaaggcguagaaccagaugauguagauuguuggugcaauacaacuucaacauggguaguauacgguacaugucaucacaagaaaggagaagcuagaagaucaaggagagcgguaacacuaccuagucauaguacaagaaaacuacaaacucgaucacaaaccugguuagaaucacgugaauacacaaaacauuuaauaaggguagaaaauuggauauucagaaauccagguuuugcacuggcagcagcugcaauagcauggcuuuuaggaucaagcacaagucaaaaagucauauaccuggugaugauauuauuaauagcuccagcuuauaguauacgauguauaggaguaaguaauagagauuucguagaaggaaugucaggagguacaugggucgaugucguucuagaacauggaggaugugucacgguaauggcacaagacaaaccaacaguagauauugaauugguaacuacaacuguaagcaacauggcagaaguaagaucauauuguuacgaagcaucuauaagugacauggcaucagauucacgaugcccaacacaaggugaagcauauuuagauaaacaaucugacacucaauauguauguaaaagaacucuaguagaucgaggauggggaaaugguugugggcuauuuggaaaaggaagccuaguaacaugcgcaaaauuugccuguucaaagaaaaugacaggaaaaucaauccaaccagaaaaccucgaauauagaauaaugcuaucaguacacggaucacaacacagcggaaugauaguaaaugacacaggacaugaaacagacgaaaacagagcaaaaguagaaauaacacccaauagccccagagcugaagcaacauuaggaggauucggaaguuuaggacuugacugugaaccaagaacaggauuagacuucagcgaccuauauuauuuaacaaugaauaacaaacauuggcuaguacacaaagaaugguuucacgauauaccuuuaccauggcacgcaggcgcugacacugguacuccacacuggaauaacaaagaagcacuuguagaauuuaaagaugcgcaugcaaaaagacaaacaguagugguacuaggcucucaagaaggugcaguacauacagcacuagcaggcgcauuagaagccgaaauggauggcguaaaaggaagacuaucaucggggcauuuaaaaugucgucuaaaaauggacaaauuaagacuaaaaggaguaucguauucauuaugcaccgcagcauucacauuuacaaaaauaccagcagaaacauuacauggaacaguaacaguagaaguacaauaugcagguacagacggaccauguaaaguuccagcacaaauggcaguggacaugcaaacauuaacaccgguaggaagauuaauaacugcaaauccaguuaucacggaaaguacagaaaauuccaaaaugauguuagaguuagacccuccauuuggagauaguuauauaguuauugguguuggggaaaagaaaauaacucaucacuggcauagaucaggcaguacgauaggaaaagcauuugaagcuacaguacgaggcgccaaaagaauggcaguauuaggagauacagcaugggacuuugguagcguagguggagcccuaaauucauugggcaaagguauucaucaaauauuuggagcugcauuuaaaagccucuucgguggaaugaguugguuuucucaaauacuaauaggaacauuauuaaugugguuaggacuaaauacuaaaaaugguucuauuagcuuuauguguuuggcacuaggaggagucuugauauuucuaaguaccgcaguaucagcaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9286 - RNA, 2290 nt, Artificial Sequence
  KU758874.1 prME-short mRNA Design 3 opt
gggagaaagcuuaccaugacaucuguugguaucguaggauuauuacucacaacagcaauggcggccgaaguaacuagaaggggaucagcauauuauauguaucuagauagaaacgaugcaggagaagccauaaguuuuccgacaacauuaggcaugaacaaaugcuauauacaaauaauggauuuagggcauaugugugaugcaaccaugagcuaugaaugcccaauguuagacgaaggaguagaaccagacgacguagauuguugguguaacacgacaaguacaugggucguauacggaacuugucaucauaaaaaaggagaagcuaggcguucaagaagagcaguaacauuaccaucacauucaacacgaaaacuucaaacaagaucacaaacauggcuagaaucaagagaauauacuaaacauuuaauaaggguugaaaacuggauauuuagaaacccaggauuugcccuagcugcagcagcaaucgcauggcuacuaggaucaaguacaagccaaaaaguaauauaucuaguaaugauacuauuaauagcuccagcauacucgauuagaugcauagguguaucaaauagagacuucguagaaggaauguccggaggaacauggguagacguaguguuagaacauggaggauguguuacaguaauggcacaggacaaaccaaccguugacauagaauuaguuacaacaacaguuaguaacauggcugagguacguucauauuguuaugaagcaucaauaucagacauggcaucagauucacgaugucccacucaaggugaagcauacuuagauaaacaaagcgacacacaauacguuuguaaacgaacacuaguagauagaggaugggggaauggauguggccuauuuggaaaaggaagccuaguaacaugugcuaaauuugcauguaguaaaaaaaugacaggaaaaagcauucaaccggaaaacuuagaauauagaauuauguuaucaguacaugguucacaacauucagggaugauaguaaaugauaccggacaugaaacugacgaaaacagagcaaaaguagaaauaacuccuaauaguccaagagcagaagccacauuagggggauuugggagucuaggacuagauugcgaaccuagaacaggauuagauuuuucagaucuauauuauuuaacaaugaacaauaaacacuggcuuguucauaaagaaugguuucacgacauaccacuaccauggcaugcaggagcagauacaggaacaccacauuggaacaauaaagaagcauuaguggaauuuaaagaugcacaugcaaaaaggcaaacugucguaguucuagguucccaagaaggugcuguacauacugcacuagcaggggcacucgaagcagaaauggacggagcuaaaggaaaacuaaguucagggcaccuaaaaugcagauuaaaaauggauaaauuacguuuaaaaggaguaucauauucauugugcacagcagcauuuacauuuacaaaaauuccggccgaaacguuacauggcaccguuacgguagaaguacaauacgcaggaacagaugggccauguaaaguaccugcccaaauggcaguugauaugcaaacacugacaccgguugggagacuaauuacugcuaacccaguaauaacugaaucaacagaaaauucaaaaaugauguuagaauuagauccaccauucggcgauagcuauauuguaauaggaguaggugaaaaaaaaauaacacaccauuggcacaggagcgguaguacaaucggcaaagcauuugaagcaacuguuagaggagcuaaaagaauggcaguguugggcgauacagcaugggauuuugggaguguaggaggggcacucaacucauuaggaaaagguauacaucaaauauucggagcagcuuuuaaaucauuauucggaggaaugagcugguuuagucaaauacuuauaggaacacuauuaaugugguuaggauuaaauacaaagaacggaagcauaucauuaauguguuuagcacuuggaggaguuuuaauauuucuaaguacagcugucagugcgugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9287 - RNA, 2290 nt, Artificial Sequence
  KY317939.1 prME-short mRNA Design 3 opt
gggagaaagcuuaccaugacaagcguaggaauuguaggacuacuguuaacaacagcaauggccgccgaaguaacaagaagaggcagcgcauauuauauguacuuagauagaaaagaugcuggagaagcaaucuccuuuccaacaacauuagguaugaauaaauguuauauacaaauaauggaucuaggacauaugugugacgcaacaaugucuuaugaauguccaauguuagaugaaggaguagaacccgaugauguagacugcugguguaauacgacaucaacuugggugguauacggaacaugccaccauaaaaaaggagaagcaaggagaucacguagagcaguuacacuuccuucucauucaacuagaaaauuacaaacacgaagccaaacuugguuagaaagcagagaauauacaaaacauuuaauaagaguagaaaacuggauauucagaaauccaggauuugcacucgcagcagcagcaauagcauggcuauuggggucaagcacaucacaaaagguaauauacuuaguuaugauauuauuaauugcaccagccuauucuauaagauguauaggaguaucuaacagagauuuuguugaagguaugucaggcggaacauggguagaugugguucuugaacaugguggauguguaacaguaauggcacaagauaaaccaacaguagauauagaauuaguaacaacaacaguaaguaacauggcagagguaagaaguuauuguuaugaagcaaguaucucagauauggcaagcgacucuagaugcccaacacaaggagaagcauaucuagauaaacaaagugacacacaauauguauguaaaagaacacuaguagauagaggauggggaaauggauguggacuuuuuggaaaagguucguuaguuacuugcgcaaaauuugcauguucaaaaaaaaugacuggaaaaaguauacaaccagaaaacuuagaguauagaauaauguuaucaguacacgggucucaacauaguggaaugauuguuaaugacacuggacaugagacagaugaaaauagagcaaaaguagaaauaacuccaaacucaccccgugcagaagcgacauuaggaggauuugguucauuaggauuagauugugaacccaggacgggacuagauuuuagugaucuauauuaucuaacuaugaauaauaaacauugguuaguacauaaagaaugguuucacgacaucccauuaccauggcacgcaggagcagauacaggaacaccucauuggaauaauaaagaagcauuaguugaauuuaaagacgcucaugcaaaacgucaaaccguaguuguacuagguagccaagaaggagcaguacauacugcauuagcaggagcauuagaagcagaaauggauggcgcgaaagguagauuaagcaguggccauuuaaaauguagacucaaaauggauaaacucagauuaaaaggaguuucauauagucuauguacagcagcauuuacauuuacaaaaauaccagccgaaacacuccauggaaccguaacaguagaagugcaauacgcaggaacagauggaccgugcaaaguaccagcccaaauggcaguagauaugcaaacauuaacaccuguaggaagauuaauaacagcaaauccaguaauuacagagucaacagaaaacagcaaaaugauguuagaacuagaucccccauucggagauaguuauauuguaauagguguaggugaaaaaaagaucacacaucauuggcacagaucaggaucaacaauugggaaagcuuucgaagcaacagucagaggugcaaaacgaauggcaguacuaggagauacagcgugggacuucggaaguguagguggagcacuaaacucacuggggaaaggaauacaccaaauauucggagcagccuuuaaaucacuauuugggggcaugucuugguucucucaaauacuaauuggaaccuuauuaauguggcuaggacuaaacacuaaaaauggaagcaucaguuuaaugugucuagcacuuggagguguuuuaauauucuuaucgacagccguuuccgcaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9288 - RNA, 2290 nt, Artificial Sequence
  KY014314.1 prME-short mRNA Design 3 opt
gggagaaagcuuaccaugacaaguguaggaauuguaggacuauuauuaacaacagcuauggcugcagaaguaacaagaagaggcagugcauacuauauguauuuagauagaaaugacgcuggagaagcaauuagcuucccaacaacauugggaaugaauaaaugcuacauacaaauaauggauuuaggccauaugugugaugcaacaaugaguuaugaaugccccaugcuagacgaaggaguugaaccagaugauguagauugcugguguaauacaacuucaacauggguuguuuaugguacaugucaccauaaaaaaggagaagcaaggcguucaagacgagccguaacacucccuucgcacucaacucgaaaauuacaaacccgaagccaaacauggcuagaaucaagagaauauacaaaacaucugauaagagucgaaaacuggauauuuagaaauccaggauuugcacuagcagcagcagcaaucgcauggcugcuugggagcucaaccucucaaaaagugaucuaucuuguaaugauacuguugauagccccagcauacucaauaagauguauagguguaagcaauagagauuucguagaaggcaugucaggaggaacauggguugauguaguauuagaacacggagguugcguuacagugauggcacaagacaaaccaacaguagacauagaacuaguaacaaccacuguaaguaauauggcagaaguacgaucuuauuguuaugaagcuaguauuucagauauggcaucggauucaagguguccuacucaaggugaggcauaccuagacaagcaaucagacacucaauacguaugcaaaagaacacuaguugauagaggauggggaaauggauguggauuguucggaaaagguucauugguaacaugugcaaaauuugcgugcucuaaaaaaaugacagguaaaucuauacaaccggaaaacuuagaguauagaauaaugcuaaguguacauggcucucaacauucuggaaugauuguaaaugauacaggacaugaaacagaugaaaauagagcaaaaguagaaauaacgccaaauaguccacgagcggaagcaacacuaggaggauuugguaguuuaggauuagacugugaaccgagaacaggauuagauuucagcgaccuauauuauuuaacgaugaauaauaaacauugguuaguacauaaagaaugguuucaugacauuccccucccauggcacgcaggggcagacacagggacaccacauuggaacaauaaagaagcacuaguagaauuuaaagaagcacacgcaaaaagacaaacaguuguaguacuaggaagucaagaaggagcaguacauacagcacuagcaggagcuuuagaagcagaaauggauggagcaaagggaagacuaucuucuggacacuuaaaauguagauuaaaaauggauaaacugagacuaaaagguguaucauauucguuauguacagcagccuucacauuuacuaaaauaccagcagaaacucuacauggaacgguuacaguagaaguacaauaugccggaaccgauggcccgugcaaaguaccagcacaaauggcaguggauaugcaaacauuaaccccaguaggaagauuaauaacagcaaauccaguaauaacagaaucaacagaaaauagcaaaaugauguuagaauuagauccaccuuuuggagauagcuacauaguaauaggagucggagaaaaaaaaauaacucaccauuggcacagaagcggaucaacaauaggaaaagcauuugaggccacaguuagaggagcaaaaagaauggcaguacuaggagacacugccugggauuuuggaagcguuggaggggcauuaaauagucuugguaaagggauucaucaaauauucggggcagcauuuaaaucacuauuuggaggaaugaguugguucucacaaauauugauaggaacauugcuaaugugguuaggacuaaauacaaaaaauggcagcauaagccucaugugucuugcucuaggaggaguucuaauauuuuuaaguacugcaguaagugcuugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9289 - RNA, 2290 nt, Artificial Sequence
  KX447517.1 prME-short mRNA Design 3 opt
gggagaaagcuuaccaugacaaguguuggaauaguaggauuacuacuaacuacugcaauggcagcagaaguaacuagaagaggcucagcuuauuacauguauuuagacaggaacgaugccggcgaagcgauaaguuuuccuaccacacuaggaaugaacaaauguuacauacaaauaauggauuugggacauaugugugaugcuacgaugagcuaugaguguccaaugcuagacgaaggaguugaaccugaugacguagauuguugguguaacacaacaagcacauggguuguauauggaacaugucaucacaaaaaaggagaagcuagaagaucaagaagagcagucacauuaccaagucauagcacaagaaaacuacaaacaagaucacaaacaugguuagaaucaagagaauauacaaaacaccuuauaagaguugaaaauuggauuuuuagaaauccaggauuugcuuuagcagcugcagcaauagcaugguuacucgguucuucaacaagccaaaaaguaaucuaucuaguaaugauauugcuaauugccccagcguacucuauucgauguauuggcguaucaaacagagauuucgucgaaggaaugucaggaggcacauggguagacguuguacuagaacacggagggugcguaacaguaauggcacaggacaaacccacaguugauauagaauuaguaaccacaacgguaucaaacauggcggaaguuagaucuuauuguuaugaggcaaguauaagugauauggcaucagauaguagauguccaacccaaggugaagcauacuuagauaaacaaucagacacacaauacguauguaaaaggacacugguagacagaggauggggaaauggauguggauuauuugguaaaggaaguuuaguaacaugugcaaaauuugcauguucaaaaaaaaugacgggaaaaaguauacaaccagaaaauuuagaauauagaauuauguuaaguguucauggaagccaacauagcgguaugauagugaacgacacaggucacgaaacugaugaaaacagggcgaaaguagaaauaacaccaaauaguccgcgcgcagaagcagcuuuaggaggauucggaucacuggguuuagauugcgaaccaagaacagguuuagauuucagugacuuguacuaccuaacaaugaauaauaaacauugguuagugcacaaagagugguuucaugauauaccauugccauggcaugccggagcagauacaggcacgccacauuggaauaauaaagaggcguuaguugaguucaaagaugcacaugccaaacgacaaacaguaguaguauuaggaucacaagaaggggcaguucacacagcauuagcaggagcauuagaagcagaaauggacggagcuaaaggaagauuaagcucaggacaccuaaaauguagauuaaaaauggauaaguugcgauuaaaagguguaucuuacucacuuuguacagcagcuuucacauuuacaaaaauacccgccgaaacacuacacgguacaguaacaguagagguacaauaugccggaacagauggaccauguaaaguuccagcacagauggcaguagauaugcaaacauuaacaccugucggaagauuaauaaccgcaaauccagugauaaccgaaucuacugaaaauucaaaaaugauguuagaauuagacccuccauuuggagauucauacauaguuauaggaguaggagagaaaaaaauuacacaucauuggcauagauccgguucaacuauaggaaaagcauuugaagcuacaguaagaggcgcaaaacguauggcaguauuaggagacacggcaugggauuucggaucaguaggaggagcauuaaacucauuaggaaaaggaauacaccaaauuuucggugcggccuuuaaaucauuauuugguggaaugagcugguuuucgcaaacauuaauaggcacuuuacucaugugguugggacuuaauacaaaaaauggaagcauaucacucauguguuuagcacugggaggaguacuuauauuuuuauccacugcaguuucagcaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9290 - RNA, 2290 nt, Artificial Sequence
  KU926310.1 prME-short mRNA Design 3 opt
gggagaaagcuuaccaugacaaguguagguauuguaggacuuuuauuaacuacagcaauggcagcagagguuacuagaagaggaucugcguauuauauguaucuagacagaaaugacgcaggagaagcaauaucuuuuccuacgacauuaggaaugaauaaaugcuauauacaaauaauggauuuaggccacaugugcgaugcaaccaugucauaugaauguccaauguuagaugaaggaguugaaccagaugauguagauugcugguguaauacaacaucaaccuggguaguauauggaaccugucaccacaaaaaaggcgaagcaagaagaaguagaagagcaguaacauuaccaucacauagcacacgaaaacuucaaacacgaagccaaacauggcuugaaaguagagaauauacuaaacaucuaauaagaguagaaaacuggauauucagaaauccaggcuuugcauuagcagcagcugccauugcauggcuauuaggcaguucaacaucacaaaaaguaauuuauuuaguaaugauucuauuaauugcaccugcauauaguauaaggugcauaggaguuuccaauagagauuuuguagaaggaaugucaggagguacauggguagauguaguucuagaacauggugguuguguaacaguaauggcucaggauaaaccaacaguagauauagaacuaguaacgacaacaguaagcaacauggcagaaguuagaagcuauugcuacgaagcaaguauaucagauauggcaagcgauucacgauguccaacacaaggagaagcuuaccuugacaaacaaucugauacucaauauguaugcaaaaggacguuaguagaucgugguuggggaaaugguuguggcuuauucggaaaaggaagucuaguuacaugcgccaaauuugcauguaguaaaaagaugacagguaaaucaauacaaccagaaaauuuagaauaucgaaucauguuaucaguacaugguucacaacauucugguaugauuguaaaugacacaggacaugaaacagacgaaaauagagcaaaaguagaaaucacaccaaacucuccaagagcugaagcaacuuuaggaggguucggcucguuaggauuagauugugaaccaagaacgggacuagacuuuucagaucuauauuauuugacaaugaauaauaaacacuggcuaguucauaaagaaugguuucaugauauaccacuaccauggcaugccggagcagacacuggaaccccccauuggaauaacaaagaagcacuaguagaauuuaaagaugcucacgcgaaacgacaaacuguaguaguacuuggaucacaagaaggagcaguacacacagcauuagcaggagcuuuagaagcugagauggacggcgcuaaaggacgacuaaguucaggccauuuaaaaugcagauuaaaaauggauaaacuaagauuaaaaggaguuucauauucacuauguacagcagcuuuuacauuuaccaaaauaccugcagaaacauugcauggaacaguuacaguagaaguacaauacgcuggagcugauggaccuuguaaaguacccgcucaaauggcaguagauaugcagacauuaacaccagucggaagauuaauuacagccaauccaguaauuacagaaucaacggaaaauucaaaaaugauguuagagcuagacccgccauuuggagauucauauauugugaucgguguaggcgaaaaaaaaauuacacaccauuggcauagaucagguucuacaauaggcaaagcguuugaagcaacugugaggggcgcaaaaagaauggcaguauuaggagauacugcaugggauuucggaaguguaggaggagcacuaaacucccugggaaaagguauccaucaaauauuuggagcggcguucaaaucauuauucgguggaaugucaugguucucacaaauccucauaggaacuuuauuaaugugguuaggacuuaauacaaaaaauggcaguauaucauuaaugugccuagcacuaggaggagucuuaauauuuuuaaguacugcaguuucagcaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9291 - RNA, 2290 nt, Artificial Sequence
  KU922923.1 prME-short mRNA Design 3 opt
gggagaaagcuuaccaugacaucagugggaauaguagguuuacuacuaacaacagcaauggcagcagaaguaacaagaagaggaucugcauauuauauguauuuggauagaaacgaugcaggggaagcaaucaguuuuccuacaacguugggaaugaauaaauguuauauacaaauaauggaccuaggacauaugugugaugcuacaaugucguaugaaugcccgaugcuggaugaagggguagaaccagaugauguagacuguugguguaauacaaccaguacaugggugguauauggaacaugucaucauaaaaaaggugaggcucgacgaaguaggagagccguaacauuaccuucacauucaacaagaaaauuacaaacaaggucacaaacaugguuagaaaguagagaauauacaaaacaucuaauuagaguugaaaacuggauauuuagaaacccaggguucgcuuuggcagcagcagcaauagcaugguuauuaggaagcucaacaucucaaaaaguuauauaucuagucaugauauuacuuauagcauuagcuuauuccauacgauguaucggaguaucaaauagagauuucguagaaggaaugucaggaggaacauggguugacguaguguuagaacaugguggcuguguaacaguaauggcacaagauaagccaacaguagacauugaauuaguaacuacaacaguaaguaauauggcagaaguaagaucuuauuguuacgaagcaaguaucagcgauauggccuccgauucaagaugcccgacacaaggugaagcauauuuagauaaacaaagcgauacgcaauacguauguaaacguaccuugguagacagagguugggguaauggaugcggauuauuuggaaaaggcucacuuguuacgugugcaaaauucgcaugcucaaaaaaaaugacuggaaaauccauacaaccagaaaaucuagaauauagaaucaugcuauccguacauggaucccaacauucagguaugaucguaaaugauacagggcaugaaacagaugaaaauagagcgaaaguagaaauaaccccaaauaguccaagagcugaggcaacuuuaggaggauuuggaucacuaggcuuagacugcgaaccgaggacagguuuagauuuuagugaucuauauuaucuuacuaugaauaauaaacauugguugguacauaaagaaugguuucacgauauaccauuaccauggcaugcaggagcugauacaggaacaccacauuggaauaauaaagaagccuugguugaauuuaaagacgcacaugcaaaacgacaaacaguagugguauuaggaagucaagaaggggccgugcacacagcauuagcuggagcucuagaagcagaaauggauggagcaaaaggaagacuaucaucaggacaccuaaaaugccgguuaaaaauggacaaacuaagacuaaaaggggugaguuacucauuguguacugcagcauuuacauucacaaagauaccagcagaaaccuuacaugguacugucacaguagaaguacaauaugcaggaacagauggaccauguaaaguaccugcacaaauggcaguagacaugcagacauuaacaccaguagguagacuaauaacugcaaaucccguuauaaccgaaucaaccgaaaauaguaaaaugauguuagaauuagauccaccuuuuggggauucauauauagucauaggaguaggagaaaaaaaaaucacucaucauuggcacagaagcggaucaacaaucgggaaagcauucgaagccacaguuagaggagcaaaaagaauggcagucuuaggagauacggccugggauuuuggaaguguagggggggcauuaaauucauugggaaaaggaauacaucaaauauuuggagcagcauuuaaaaguuuguucgguggaaugucaugguuuucucaaauacuaauaggaacucuauuaauguggcuaggucuuaauacaaaaaaugggaguauaucauuaaugugccuagcauuagguggagucuugauauuccuaagcacagcaguaagcgcaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9292 - RNA, 2290 nt, Artificial Sequence
  KY075937.1 prME-short mRNA Design 3 opt
gggagaaagcuuaccaugacaaguguaggaauaguuggauuacucuuaacaacagcaauggcagcagaaguaacaagaagggguucagcauauuauauguaucuagaucgaaaugaugcaggagaagcaauaaguuuucccacaacuuugggaaugaacaaauguuauauacaaauaauggacuugggacauaugugugaugcuacuauguccuaugaauguccaauguuagacgaaggaguagaacccgacgauguugauugcuggugcaacacaacaaguacuuggguuguauacggaacaugccaucacaagaaaggagaagcaagaagaucaagacgagcaguaacuuuaccaagucauaguacaagaaaauuacaaacacgaucacagacauggcucgaaucaagggaauauacaaaacaucuaauuagaguagaaaauuggauauucagaaauccaggauuugcauuagcagcugcagcaaucgcauggcuuuuagguucaucgacuucacaaaaaguuauauauuuaguaaugauacuucuaauagcccccgcauauucaauucggugcauuggagucucgaaucgagacuuuguggaaggaaugucagguggaacauggguagauguagucuuagaacauggaggaugcguuacuguaauggcucaagauaaaccuacaguagauauagagcuaguaacaacuacaguaaguaauauggcagaaguaagaaguuauuguuaugaggcaaguauaucugauaugguaucagauucaagauguccaacacagggagaagcauaccuagauaaacagucagauacucaauauguuuguaaaagaacauuaguagaucgaggaugggguaauggcuguggauuauuuggaaaaggaucacuuguaacaugugcgaaauuugcauguucaaagaaaaugacaggcaaaucaauucaaccagaaaauuuagaauacagaauaaugcuaaguguacacgguucacaacauuccggcaugauaguaaacgacacuggacaugaaacugacgaaaauagagcaaaaguugaaauaacaccaaauaguccuagagcagaagcaacauuagguggauuuggaucauugggauuagauugugaacccagaacaggucuggauuuuucagauuuauauuaccuuaccaugaacaauaaacauuggcuagugcauaaagaaugguuccacgacauaccacuaccuuggcaugcaggagcagauacaggaacaccacauuggaauaauaaagaggcuuuaguugaauuuaaagacgcacaugcuaaaagacaaacaguaguaguauuaggaagucaagaaggagcaguacauacagcacuagcuggugcauuagaagcagaaauggacggugcaaaagguagauuaucaucaggacacuuaaaauguagauuaaaaauggauaaacuacgccuaaaagguguaucauauucucuauguacagcagcauuuacauucacaaaaauuccugcagaaacauuacaugguacaguaacaguagaaguacaguaugcaggaacggauggacccuguaaaguaccagcacaaauggcaguagauaugcaaacauuaacaccagucggaagauuaauuacugccaacccaguaauuacagaaaguacagaaaacagcaaaaugauguuagaacuagacccacccuuuggagacucuuauauaguaauagguguaggagaaaagaaaauaacacaucauuggcaucguagugguagcacaauaggaaaagcguucgaagcaacaguaagaggagcaaaaagaauggcuguauuaggugauacagcuugggauuucggauccguaggaggagcacucaacaguuuaggaaaagguauucaccaaaucuuuggagcagcauuuaaaaguuuauuuggaggaaugagcugguuuagucaaauauuaauugguacucuauuaaugugguuaggauuaaauacuaaaaauggaucaauaagucuaaugugccuagcauuaggcgguguacuaauauuucugucuacagcgguuucagcuugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9293 - RNA, 2290 nt, Artificial Sequence
  KY003156.1 prME-short mRNA Design 3 opt
gggagaaagcuuaccaugacaucaguugggauugugggucuucuuuuaacaacagcuauggcagcagaaguaacaagaagaggaucagcauacuacauguauuuagaucgaaaugaugcuggagaagcaauaaguuuuccaacuacuuuaggaaugaauaaauguuauauacaaauuauggauuuaggacauaugugugaugcuacuaugagcuaugaauguccaaugcuagaugaaggaguagaacccgacgauguagauugcugguguaacacuacaagcacguggguuguauauggaacuugccaccauaagaaaggagaagcuagaagaaguagacgagcaguaacacuaccuagucauucaacgagaaaacuacaaaccagaucacaaacauggcuagaaucaagagaauauacaaaacaccucauaagaguugaaaacuggauauuuaggaacccaggauuugcucuagcagcagcugcaaucgcaugguuauuaggauccucaacaucacaaaaaguuauauacuuaguaaugauuuuauuaauagcaccagcuuauuccauuagauguauagguauaagcaacagggacuuuguagaaggaaugaguggaggaacuugggucgauguagucuuagaacacggcggaugcguaacuguaauggcacaggauaaaccaacuguagauauagaauuaguaaccacaacuguaucuaauauggcugaaguaagaucauacugcuaugaagcaaguauaucugauauggcaucagacucaagaugcccaacacaaggagaagccuauuuagacaaacaaagugauacacaauacguauguaaaaggacauuaguagauagaggauggggaaauggcugcggauuauuugguaaaggaagucuaguaacuugugccaaauucgccuguucaaagaaaaugacaggaaaaucaauucaacccgaaaaucucgaauaucguauaauguugucaguacacggaucacaacauaguggaaugauaguuaacgacacuggccacgaaacggacgaaaaucgagcaaaaguagaaauaacaccaaauaguccuagagcagaagcgacauuaggaggauuuggcauauuaggauuagauugugaaccaagaacuggacucgauuuuucagauuuauacuauuugacaaugaauaauaaacacugguuaguacacaaagaaugguuucaugacauaccuuuaccguggcaugcaggagcagacacaggaacgccucacuggaacaauaaagaagcauuaguggaguucaaagaugcacacgcaaaaagacaaacaguaguaguauuagguagucaagaaggagcaguacauaccgcacuagcuggcgcuuuagaagcagaaauggauggcgcaaaaggaagauuaucaagcggacauuuaaaauguaggcuaaaaauggauaaacuaagauuaaaaggaguaagcuauagcuuaugcacagcagcauucacauuuacaaaaauaccagcagagacauuacaugguacaguuacuguagaaguccaauaugcagguacugauggaccauguaaaguaccggcacaaauggcaguagacaugcaaacauuaacaccuguugguagacuaaucacagcaaauccuguaauaacagaaucaacagaaaacucgaaaaugauguuagaauuggacccuccauuuggagacucauauauugucauaggaguaggagaaaagaaaauaacucaucauuggcauagaucaggaucaacaauaggaaaagcauuugaagcaacagugagaggagccaaaagaauggcgguucuuggagacacagcuugggauuuuggaucuguaggaggagcauuaaauaguuuaggaaaaggaauacaucaaauauuuggcgccgcuuuuaaaagccuuuuuggaggaaugucaugguuuagucaaauacugauagguacgcuauuaauguggcuugguuugaauacgaaaaauggaaguauaaguuuaaugugucuggcacuuggagggguauuaauauucuuaucaacagcagugucagcaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9294 - RNA, 2290 nt, Artificial Sequence
  KU312313.1 prME-short mRNA Design 3 opt
gggagaaagcuuaccaugaccaguguagggauaguaggauuacuauuaacuaccgcaauggccgccgaaguaacaagaagaggcagugcauauuacauguacuuagacaggaaugacgccggugaagcuauaaguuuuccaacaacuuuaggaaugaauaagugcuauauucaaauaauggacuuaggacauacgugugaugcaacaaugucauaugaauguccgauguuggacgaaggaguagaaccagaugauguagauuguugguguaacacaacgaguacauggguuguauauggaacuugucaucacaagaaaggagaagcaagaagaagcagacgagcaguaacccuucccucucacaguauaagaaaacuacaaacaaggagccaaacauggcuagaaaguagagaauauacaaaacaucugauuagaguugaaaauuggauauucagaaauccuggauuugcguuagcagcggcagcaauagcaugguuauuagguaguucaacaagucaaaaaguaauuuaccuaguaaugauauuacuaauugcaccagcauacucuauaaggugcaucggaguaucaaauagagauuucguagaagguaugucaggaggaacauggguagacguaguguuagaacaugguggauguguaacuguaauggcgcaagauaaaccaacaguggauauagaacugguaacaacuacuguaagcaauauggcagaaguacgaucguauuguuaugaggccaguauaucugauauggccagugacaguagaugcccaacacaaggugaagcauaccuagacaaacaaucagacacucaguauguuuguaaacgaacauuaguagaucgagguugggguaauggauguggguuauucggaaaaggaaguuuaguaacuugugcaaaauuugcauguucaaagaaaaugacaggaaaaucaauacaaccagaaaaucuagaauauagaauaauguuaucuguacaugguagccaacacagcggaaugauuguuaacgacacaggacaugaaacggaugaaaauagagcgaaaguugaaauaaccccaaauagcccaagagcagaagcaacuuuagguggauuuggaucauuagguuuagauugugaaccaagaaccggacuagacuuuagugaccuauauuauuuaacaaugaauaauaaacauugguuaguacauaaagaaugguuucacgauauaccacucccauggcacgccggagcagauacagguacaccacacuggaauaauaaagaagcauuaguagaguucaaagaugcgcacgcaaaaagacaaacuguugugguucuaggaagucaagaaggcgcaguucauacugcauuagcgggagcacuagaggccgaaauggacggagcaaaaggaagacuuagcucaggucaucuaaaaugcagauuaaaaauggauaaacuccgauuaaaaggaguaucauacaguuuauguacagcagcauuuacauuuacaaaaauaccagcagaaacucuacauggaacugugacaguagaaguacaauacgcggguacugacggaccuuguaaaguaccagcucaaauggccguggauaugcaaacauuaacaccaguuggaagauuaauuacagcuaacccaguaauaacugaaucaacagaaaacagcaaaaugauguuagaauuagacccgccauuuggagacaguuauauaguaauuggaguaggcgaaaagaaaauaacucaucacuggcaccgaucaggaucaacaauagguaaagcauuugaagcaacuguucgaggagcaaaaaggauggcaguacuaggcgauacagcgugggauuuuggaucuguaggaggugccuuaaauucuuuaggaaaagguauacaccaaauuuuuggagcagcauuuaaaucacuauuugguggaaugagcugguucucacaaauauuaauaggaacacuauuaauguggcuuggucuaaaugcuaaaaaugguaguauaaguuuaauguguuuagcauuaggaggaguacuaaucuuccuaagcaccgcaguaucagcaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9295 - RNA, 2290 nt, Artificial Sequence
  KY075935.1 prME-short mRNA Design 3 opt
gggagaaagcuuaccaugacauccguagguauaguaggauuacuacuaacaacagccauggccgcagaaguaacccgucgaggaucugcauacuauauguauuuagaccgaaacgacgcaggagaagcuauauccuucccaacaacucuaggaaugaauaaauguuauauucaaauaauggauuuaggacauaugugcgaugcaaccaugucauaugaauguccaauguuagaugaagggguagaaccagaugauguagacugcugguguaauacaacuuccacauggguuguauacggaacgugucaucauaagaaaggagaagcgcaaagaaguagacgagcaguuacacuaccaagucauaguacaagaaaauuacaaaccagaucucaaacauggcuagaaucaagggaauacacuaaacaucuaauaagaguagaaaauuggauuuuuagaaauccuggauuugcacuagcggcagccgcaauagcauggcuauuaggaaguucuacaucacaaaaaguaauauacuuaguaaugauacuauuaauagcaccagcuuacaguaucagaugcauaggaguuucaaacagagauuucguagaaggcaugaguggaggaacauggguugauguaguacuagaacaugguggaugcguaacaguaauggcacaagacaaaccaacaguagauauugaauuaguaacaacaaccguaucaaauauggcugaagucagaaguuacuguuaugaagcuagcauaagugauauggcaagugauucaaggugcccaacacaaggugaggcuuaucuagacaaacaaagugacacacaauauguauguaaaagaacuuuaguagaccgaggauggggaaauggauguggauuauucggaaaaggauccuuaguaacuugcgcuaaauuugcguguucaaagaaaaugacagguaaaaguauacaaccagaaaauuuagaauauagaauaaugcuaucaguacacggaagccaacauucaggcaugauaguaaacgauaccggacaugaaaccgacgaaaacagagcaaaaguugaaauuacacccaacagcccccgagcagaagcaacccuuggagguuuuggcagcuuaggauuagauugugaaccaagaaccggauuagauuuuagugaccuauauuaucuaacaaugaauaauaaacauugguuaguacacaaagaaugguuucacgacauaccauuaccauggcaugcaggagcagacacuggaacaccacauuggaauaauaaagaagcauuaguagaauuuaaagaugcucaugcaaaacgacaaacaguaguaguauuaggcagucaagaaggggccguacauacagccuuagcaggggcacucgaagcagaaauggacggagcuaaaggaagacuaucaaguggucauuuaaaaugucgcuuaaagauggauaaauugagauuaaaaggaguaaguuauucacuauguacagcugcauuuacauucacaaaaauaccagcagaaacacuucauggaaccguaacaguagaaguacaauaugcagggacagauggaccauguaaaguaccugcacaaauggcaguugauaugcaaaccuuaacaccaguaggaagacuaauaacagcaaauccaguaauaacagaaucgacagaaaauaguaaaaugauguuagaauuagacccacccuuuggagacucauauauagugauagguguaggugaaaagaaaauaacucaccauuggcauagauccggaaguacaauaggaaaagcauuugaagcaacaguaagaggagcgaaacguauggcuguacuaggagauacagcaugggauuuuggaucaguaggaggagcacuaaauagccuuggaaaaggaauacaccagauauuuggagcagcauuuaaaucuuuauuuggaggaaugucaugguucagucaaauauuaauagguacauuacuaaugugguuagguuuaaacacuaaaaauggaucuauaucuuuaauguguuuagcauuagggggaguuuuaauauuucuaucaacagcuguaagugcaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9296 - RNA, 2290 nt, Artificial Sequence
  KY014320.1 prME-short mRNA Design 3 opt
gggagaaagcuuaccaugacuuccguagguauaguagguuuacuauuaacaacugccauggccgcagaaguaacuagaagagguagcgcauauuauauguacuuagaucgaaacgaugccggagaagcaauaucauucccaacaacauuaggcaugaauaaauguuauauacaaauaauggauuuaggacauaugugugaugcaacaaugucauacgaauguccgaugcuagacgaagguguagaaccagacgauguagacuguugguguaacacaacuuccacauggguuguuuauggaacuugucaucauaaaaaaggagaagcaagacguucacguagagcuguaacccuaccaucacauucaacaagaaaacuucaagcaagaucacaaacauggcuagagucuagagaauacacaaaacauuuaauaagaguagaaaacuggauauuuagaaauccgggauucgcuuuagcugcagcagcaaucgccuggcuauuagguucaagcacaagucaaaaaguaauauacuuagucaugauauuauugauagccccagcuuauucaauaagauguauaggaguuucaaacagggauuuugucgaaggaaugucaggaggaacauggguagaugucguauuagaacacggaggauguguaacaguaauggcacaagauaaaccaacaguugacaucgaauuaguuacaacgacaguaagcaauauggcugaaguaagaucuuauuguuaugaagcaagcauuagugacauggcaagugauucaaggugcccaacacaaggagaagcuuauuuagacaaacaauccgauacucaauacguauguaaaagaacauuaguggauagaggauggggcaauggauguggccuauuugguaaaggaaguuuaguaacuugugcaaaauuugcauguaguaaaaaaaugacagguaagagcauacaaccagaaaaucuagaauaucgaauaauguuaucuguucauggcagucaacacucaggaaugauaguaaaugacacaggacaugaaacugaugagaauagagcaaagguagaaauaacaccaaacagcccaagagcugaagcaacauuaggaggguuuggaucauuaggacucgauugugaaccaaggacuggcuuagacuuuucagauuuauauuauuuaacaaugaauaauaaacauuggcuaguacacaaagaaugguuucaugauauuccgcuaccauggcacgcaggagcagauacgggaacuccccauuggaauaauaaagaagccuuaguagaguucaaagacgcacacgcaaaaagacaaacagucguaguacuuggaagucaagaaggagcaguacauacagcuuuagcaggggcucuugaagcagagauggacggagcaaaaggaagacugucaagcggacaucuaaaaugcagauuaaaaauggauaaacuaagauuaaaaggaguaucuuacagucuuugcaccgcugcuuuuaccuuuacaaaaauaccagcagaaacuuuacauggaacuguuaccguagaaguccaguacgcuggaacagauggcccaugcaaaguacccgcacagauggcuguagauaugcaaacauuaacaccaguagguaggcugauaacagcaaaucccguaauaacagaaucaacagaaaauucaaaaaugaugcuagaacuugacccaccuuuuggcgauaguuauauaguuauaggaguaggagaaaaaaaaauaacacaucauuggcacagaucugguuccacgaucggaaaagccuuugaagcaacaguaaggggagcgaaaagaauggcuguacuaggugacacagccugggauuucggaucaguuggaggugcacuaaauucauuaggaaaaggaauacaccaaauuuuuggagcagcauuuaaaucauuauucggcggaaugagcugguuuucacagauuuuaauaggaacacuauuaauguggcuaggacuaaauacaaaaaauggaucgauaagucuaaugugucuagcacuaggaggaguauugauauuucuaucaacggcaguuucagcaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9297 - RNA, 2290 nt, Artificial Sequence
  KY328290.1 prME-short mRNA Design 3 opt
gggagaaagcuuaccaugacaucaguaggcauaguaggacuauuacuaacaacagccauggcagcggaaguaacaaggagaggaucugcauauuacauguacuuagaucgauccgaugcaggagaagcaauaaguuuuccaacaacuuuagguaugaauaaauguuauauacaaauaauggauuuaggacacaugugugaugcuacuaugucuuaugaaugcccaauguuagacgaaggaguggaaccugaugauguugauuguugguguaauacaacaaguacauggguaguauaugguacaugucaucauaagaaaggagaagcgaggagaucaaggagagcuguaacauuaccaagucauagcacaagaaaauuacaaacaagaagccaaacuugguuagaaaguagagaauacacaaagcauuuaauaagaguagaaaauuggauauuuagaaacccaggauuugcacuagcagcagcagcaauagcauggcuauuaggcaguaguaccucacaaaaagucauauauuuaguuaugauacuuuuaauagccccugcauauagcauuagauguauaggcguuagcaaucgagauuuuguagaagguaugucaggagguacuuggguagauguaguauuagaacacgggggaugugucaccguaauggcccaagacaaaccaacuguagauauagaguuaguuacuacaacaguaagcaauauggcagaagucagaaguuauugcuacgaagcaagcauaagcgauauggcuagugauagccgauguccuacccaaggagaggcguauuuagauaaacaaucugacacgcaauauguauguaaaagaacucuaguagacagaggauggggcaacggaugcggauuauuuggaaaagguagcuuaguaacaugugcaaaauuugcauguucaaagaaaaugacuggaaaaaguauucaaccagaaaacuuagaauaucgaauaaugcuaucaguacauggaagucaacauucaggaaugauaguaaacgacacuggacacgagacagaugaaaaucgagcgaaaguagaaauaacaccaaauucaccuagagcugaagcaacauuagguggauuugguagcuuaggauuagauugugaaccaagaaccggucuagauuucagcgaccuauauuauuuaacaaugaauaauaaacacuggcuaguacauaaagaaugguuucaugauauuccucuaccuuggcacgcuggagccgacacuggaacaccucauuggaacaauaaagaagcguuagucgaguucaaagaugcccacgcaaaaagacaaacuguaguaguauuaggaucacaagaaggagcaguacauacagcacuagcaggagcacuagaagcagaaauggauggagcaaagggaagauuaagcaguggacaccuaaaauguagacuaaaaauggacaaacuaagauuaaaaggaguuucuuauagucuaugcacggcagcuuucacauuuaguaaaauuccagcugaaacauuacauggcacaguaacagaagaaguccaauaugcagguacugauggaccauguaaaguaccagcacaaauggcaguagauaugcagacacuaacacccguagguaggcuuauaacagcgaauccaguaauaacugaaaguacugaaaauaguaaaaugauguuagaauuagaucccccauuuggugauucauacauaguaauaggaguaggagaaaagaaaauuacacaucauuggcaccguucaggaucaacaaucggaaaagccuuugaagcaacuguuagaggagcaaaacgaauggcaguuuuaggagauacugcaugggauuucggaaguguaggaggggcauugaauagcuugggaaaagguauucaucaaauauucggagcagcauuuaaaagucuauuuggugguaugaguugguuuagucaaauacuaauuggaacauuacuaauguggcuagguuuaaauacgaaaaacggaucaaucaguuuaaugugccuagcucuaggcggcguccuaauauuuuugaguacagcaguuuccgcaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9298 - RNA, 2290 nt, Artificial Sequence
  KU681081.3 prME-short mRNA Design 3 opt
gggagaaagcuuaccaugacaucuguaggaauaguaggacuacuacuaacuacagccauggcugcagagguaacaagaagaggaucagcauauuauauguauuuggauaggucagaugccggugaagcaauaaguuuuccuacuacauuaggaaugaacaaauguuauauacaaauaauggauuuaggacauaugugugaugcaacaaugaguuaugaaugcccgaugcuagaugaaggagucgaaccagaugaugucgauuguuggugcaacacaacaucaacguggguugucuauggaacaugucaccacaagaaaggugaagcuagaagaucaaggagagcaguuacauugcccagucauaguacaagaaaauuacaaacaagaagucaaacaugguuagaaaguagagaauauacuaaacaucuaauacguguggaaaauuggauauuuagaaauccaggauuugcgcuagcagcagcagcaauagcaugguuacuagguucuaguacaagucaaaaaguaauauaucuagugaugauauuauuaauugcacccgcauauaguauaaggugcauaggugucagcaauagagauuuuguggaaggaaugucuggaggaaccuggguugauguaguuuuagaacaugggggaugcguuacaguaauggcacaggauaaacccacaguugauaucgaauugguuacgacaacaguuaguaacauggcagaaguaagaucauacuguuaugaagcaaguauaucagauauggcaucagauucaagauguccaacccaaggagaagcauauuuagacaaacaaagugauacccaauacguauguaaacgaacucuuguagauagaggauggggaaacggauguggauuauuuggaaaagguagucuaguaacuugcgcaaaauuugcuuguucaaagaaaaugaccggaaaaucaauacaaccagaaaacuuagaauauagaauuaugcuaaguguacauggaucucagcacagcgggaugauaguuaacgacacaggucaugaaacagacgaaaauagagcaaaaguagaaauaacaccaaacaguccaagagcagaagcaacccuugguggauuugggaguuuaggucuggauugcgaaccgagaacaggauuagauuuuagugauuuauauuaucuaacaaugaauaauaaacauugguuaguacauaaagaaugguuccaugauauaccacuuccauggcauacgggagcagacaccggaaccccacauuggaacaauaaagaggcauuaguugaauuuaaagacgcacacgcaaaaagacaaacaguaguaguacugggcucccaagaaggagcaguacauacagcacuagcgggugcacucgaagcagaaauggauggagcgaaaggaagauuaagcaguggccaucuaaaauguagguugaaaauggacaaacuaagguuaaaaggaguaaguuacagccucuguacagcugcuuucaccuuuacaaaaauaccggcagaaacauuacacggaacaguaacaguagagguucaauaugcaggaacagauggaccauguaagguuccagcacaaauggcagucgauaugcaaacauuaacuccaguuggaagauuaauaacagcaaauccuguuauaacagaaggaacagaaaacucaaaaaugauguuagaacuagauccaccauuuggcgauaguuauaucguaauaggaguaggggaaaagaaaauaacucaucacuggcauagaagcggaucaaccauagguaaagcauuugaagcaacgguaaggggugcaaaaagaauggcaguauugggagacacagcuugggacuuuggaaguguaggagguguauuaaacagucuaggaaaaggaauacaucaaauauuuggagcagcauuuaaaaguuuauuuggaggaaugagcugguuuucacaaauauuaauaggaacauuacuuaugugguugggacuaaauacuaaaaauggaucgauaagccugauguguuuagcacuagguggaguuuuaaucuuccuaaguacagcaguaagugccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9299 - RNA, 2290 nt, Artificial Sequence
  KX827309.1 prME-short mRNA Design 3 opt
gggagaaagcuuaccaugacaucaguaggaauaguaggauuacuacuaaccacagcaauggcagcagagguaacaaggagaggaucagcauauuauauguauuuagaucgaucagacgcaggagaagcaauaaguuuuccaaccacgcuaggcaugaauaaauguuacauucaaauaauggacuuaggucauaugugugaugcaacaauguccuaugaauguccuauguuagaugaaggaguugaaccugaugauguugauuguugguguaacacaacaucaacuuggguaguauaugguacaugucaccauaaaaaaggagaagcuagacgaaguagaagagcuguaacacuaccaagccacucgacuagaaaacuacaaacaagaucacaaacaugguuagaaaguagagaauacacaaaacaucuuauacgaguagagaauuggauauuucgcaauccaggauuugcacuagcagcagcagcaauagcgugguuauuagguucaucuacaagccaaaaaguaauauauuuaguaaugauauuauuaauagcaccagcguauucaauaagauguauaggagucaguaauagggauuucguagaaggaaugucuggcggaacauggguagauguaguacuagaacauggaggaugcguaacaguaauggcucaagauaaaccaacuguugauauagaauuaguaacaacaacaguaagcaauauggcagaaguaagaucauacuguuaugaggcaaguauaagugauauggcaucagauagcagaugucccacacaaggcgaagcauaucucgacaaacaaagcgacacgcaauauguauguaaacgaacucuaguagauagagguugggguaacggcuguggacuauuuggaaaaggaaguuuaguaaccugcgcuaaauucgcauguucaaaaaaaaugacgggaaaaucaauacaaccagaaaacuuagaauauagaauaauguuaagcguacauggcagucaacacucaggaaugauaguaaaugauacaggucaugagacugacgaaaaccgagccaaaguagaaauaacuccaaauucaccaagagcugaagcaacacuuggagguuuuggcaguuuagguuuagacugugaaccaagaacaggacuagacuuuuccgaucuauauuaccuaacaaugaacaauaaacauugguuaguacauaaagaaugguuucaugacauaccauuaccuuggcaugcaggagcagauaccggaacaccucacuggaauaauaaagaagcacuaguugaauucaaagaugcacaugcuaaaagacaaacugucguuguacuagguagucaagaaggagcaguucauaccgcacuagcgggagcacuugaagcagaaauggacggggcaaaaggaagauuaagcucaggacauuuaaaaugcagacuaaaaauggauaaacuaagacuaaaaggagucucauauaguuuauguacagcagcguuuacauuuacaaagauuccagcagaaacauuacauggaacaguaacuguagaaguacaguaugcaggaacugacggaccauguaaaguuccagcacaaauggcuguugauaugcaaacuuuaacuccaguaggaagauugauuacagcaaaucccgugauaacagaauccacagaaaauucuaaaaugauguuagaacucgaucccccguuuggagauagcuauauaguaauaggaguaggagaaaaaaaaauaacacaccauuggcacaggucagguuccacaauagguaaagcuuuugaagcuacaguaagaggagcuaaaagaauggcuguacuaggagauacagcaugggauuuuggaagcguaggcggagcacuuaauucauuaggaaaagguauccaccaaauauucggagccgcuuucaaaucuuuauuuggaggaaugaguugguuuagccaaauauuaauaggcacucuacuaaugugguuaggacuaaacacuaaaaauggaucuauaucauuaauguguuuagcauuaggcggaguucuaauuuuucucucaacagcaguaucugcuugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9300 - RNA, 2290 nt, Artificial Sequence
  KU955593.1 prME-short mRNA Design 3 opt
gggagaaagcuuaccaugacaucaguaggaauaguuggauuauuauuaacaacagcaauggcaguagaaguaacuagaagaggaaaugcauauuacauguacuuagaucgaucagaugccggugaagcgauuagcuuuccaacaaccaugggaaugaacaaaugcuacauacaaauaauggaccuaggccauaugugcgacgcuacaaugucauacgaauguccuauguuagaugagggaguagaaccugaugauguugacuguugguguaauacaacaaguacuuggguaguauauggaacaugccaucauaagaaaggagaagcaaggagaucaagacgagcaguaacacuuccaagccauucaacuagaaaacuucaaacaagaucucaaacguggcuagaaucaagagaauauacaaaacacuuaauaagaguagaaaauuggauuuuccgaaauccaggcuuugcauuagcagcagcugcaauagcuugguugcuaggaaguucaacaucacaaaaaguaauuuaccucguaaugauauuauuaauagcacccgcauacucaauucgaugcauaggaguaaguaacagagacuuugucgaagguaugucaggagggacuuggguagauguaguacuagaacauggagguugcguaacaguaauggcucaagauaaaccaacaguagacauagaauuagucacuacaacgguaucaaacauggccgaaguacgaucauauuguuaugaagcaucaauaucagacauggccagugacuccagauguccaacacaaggugaagccuaucuagauaaacaaagugauacgcaauauguauguaaacgaacacuuguagacagagguuggggaaacggcugcgguuuauuugguaaaggaaguuuaguaacaugugccaaauuugcauguuccaagaaaaugacagguaaaagcauacaacccgaaaauuuggaauaucgaauuauguuaucaguacacggaucacaacacucagguaugauagucaaugauacuggucacgaaacugaugaaaauagagcaaaagucgaaauuacacccaauucgccuagagcugaagcaacguuaggaggauuuggcucauuaggauuagauugcgaaccaagaacaggucucgauuucucagacuuauauuacuuaaccaugaauaauaaacauuggcucguucacaaagaaugguuucaugauauaccucuacccuggcaugcaggagcagauaccgguacaccacauuggaauaacaaagaagcgcuaguagaauuuaaagacgcacaugcaaaacgacaaacuguaguaguuuuaggaucacaagaaggagcaguacauacugcauuagcuggagcauuagaagcagaaauggauggagcaaaaggaagguuaaguaguggucauuuaaaauguagauuaaaaauggauaaguuaagacuaaaaggagugaguuauucacuaugcacagccgccuuuacauuuacuaaaauuccagcagaaacauugcauggaacagucacaguggaaguacaauacgccggaacagacggaccaugcaaagucccagcacaaauggcaguagauaugcaaacauuaaccccaguaggaagacuaauaacagcaaauccuguaauaacugaaucaacggaaaauucaaaaaugauguuggaauuagauccaccauuuggcgauucauauauaguuauaggcgucggagaaaagaaaauaacccaucauuggcacagaucagguucaacaauaggaaaagcauuugaggccacgguaagaggcgcaaaaagaauggcaguauuaggagacacagcaugggauuucggaagcguuggaggagcacucaauagcuuagguaaaggaauccaucaaauuuuuggagcagcguucaaaucauuauuugguggaaugucaugguuuucacaaauauuaauaggaacuuuauuaguaugguuaggacuaaauacuaaaaacggaucuauaagccuaauguguuuagcacucggaggaguauuaauuuuccuaaguacagcaguuagugcuugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9301 - RNA, 2290 nt, Artificial Sequence
  KY272987.1 prME-short mRNA Design 3 opt
gggagaaagcuuaccaugacaucaguaggaauaguuggucuauuauugaccacagcaauggcugccgaagugacaagaagagguucagcauauuauauguaucuugaucggucugaugcaggagaagcgauaaguuuuccaacaacucuaggaaugaacaaauguuauauacaaauaauggaccuagggcauaugugugacgcaacaaugaguuaugaauguccaaugcuagaugaaggaguagaaccagacgauguugacuguugguguaauaccaccaguacauggguaguauauggcacaugucaucauaaaaaaggagaagcgcgacguaguagacgcgccguaacacucccaucacauucaacaagaaaacuucaaacaagaagccaaaccugguuagaaaguagagaauacacaaaacaccuuauaagaguagaaaacuggauauuuagaaauccaggcuucgcauuagcagcugcagcaaucgcaugguuacucggaucaucaacaucccaaaaaguaauauaucuagugaugauacuauuaaucgcaccagcauacucaauaagauguauaggaguaaguaacagagauuuuguugaagguaugaguggggggacauggguagauguaguacuagaacauggcggaugcguaacagucauggcucaagauaaacccacaguagauauagaacucguaacaacaacaguaucaaacauggcagaagucagaucauauuguuaugaggcaaguauaagugacauggcaucagacaguagguguccaacccaaggagaagcuuaucuagacaaacaaagugauacccaauauguauguaaaagaacuuuaguagacagaggauggggaaauggaugcggauuauuuggaaaagguucguuaguaacgugcgcaaaauucgcauguagcaaaaaaaugacugguaaaucaauacaaccagaaaaucuagaauacagaauaaugcucucugugcacgguagucaacauucuggaaugauaguaaaugauacaggacaugaaacggaugagaacagagcaaaaguagaaauaacaccaaacaguccaagagcagaagcaacacuaggggguuucgguucuuuaggauuagauugugaaccaagaacaggacuagauuuuagcgaucuauauuauuuaacaaugaacaacaaacauugguuaguacauaaagaaugguuucaugauauaccacucccauggcaugcaggcgccgauacaggcacaccacauuggaauaacaaagaagcacuaguggaauuuaaagaugcacacgccaaaagacaaacuguaguaguacuaggaucacaagaaggagcuguacauacagcauuagcaggugcacuagaggcagaaauggauggagcaaaaggaagauuaucuagcggccaucuaaaaugcaggcuaaaaauggauaaauuaagacuaaaaggagugucauacucucucuguacugcagcauucacuuuuacaaaaauacccgcagaaacguuacacggaacuguaacagucgaaguucaauaugcaggaacagauggaccauguaaaguaccagcacaaauggcaguagauaugcaaacuuuaacuccaguuggccgacuaauuacagcaaauccaguuauuacagagucaacagaaaauagcaaaaugaugcuagaauuagacccaccauucggagauucauauauagucauaggggucggagaaaaaaaaauuacgcaucacuggcacagaagcggaucaacaauaggaaaagcuuucgaagcgacaguaagaggagcaaaaagaauggcaguuuuaggggauacagcaugggacuuuggauccgucgguggagcacuaaauagucuaggaaaaggaauacaucaaauauucggagcggccuuuaaaucgcuauuuggaggcaugucaugguuuagucaaauucuuauagguacuuuacuaaugugguuaggguuaaauacgaaaaacgggucaauaaguuuaguauguuuagcucuaggaggagugcucauauuccuaucaacagcgguaagugcaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9302 - RNA, 2290 nt, Artificial Sequence
  KY007221.1 prME-short mRNA Design 3 opt
gggagaaagcuuaccaugacaaguguaggaauuguaggauuauuacugacaacugcuauggcagcagagguuacaagaagaggaagcgcauauuauauguaucuagauagaucagaugcuggugaagcaauuucuuuuccaacaacauuaggaaugaauaaauguuacauacaaauuauggauuuaggacauaugugugacgcuaccaugaguuaugaauguccaauguuagaugaaggaguugaaccagaugacguagauuguugguguaauacaacaucaacauggguaguauaugggacaugccaucauaagaaaggagaagcaagacgaaguagacgagcuguaacauugccaucacauucaacaagaaaauugcaaacuagaucacaaacuuggcuagaaaguagagaauauacaaaacauuuaauccgaguagagaauuggauauuccgaaauccuggauuugcauuagcagcagcagcaauagcguggcuucucgguaguucaacaucacaaaaaguuauauacuuggucaugauauuauuaauagcuccggcauauagcaucagauguaucggaguaaauaaucgagauuucguagaaggaaugucagguggaacguggguagauguaguauuagaacacgguggauguguaacuguaauggcacaagauaaaccaacuguugauauagaacucguaacaacgacaguaaguaauauggcggaaguacgaaguuauuguuaugaagcauccauaucugauauggcaucagacagcagauguccaacccaaggagaagcauaccuggauaaacaaucagauacgcaauauguauguaaaagaacuuuaguugacagaggauggggaaauggaugcggcuuauucggcaaaggaaguuuaguaacaugcgcaaaauuugcguguaguaagaaaaugacaggaaaaagcauacagccagaaaaccuagaauauaggauaauguugaguguacauggcagucaacauaguggaaugauagucaaugauacuggccacgaaacagaugaaaauagggcaaaaguagaaaucacaccaaauagcccucgagcagaagcaacauuaggaggauuuggaucuuuaggucuagauugugaaccaagaacaggcuuagauuuuucagacuuauacuaucuuacaaugaauaacaaacauuggcuaguacauaaagaaugguuucacgauauaccacuaccuuggcaugcaggagcagacacuggaacaccacauuggaauaacaaagaagcacucguagaauuuaaagacgcacaugcaaaaagacagacagugguaguuuuaggaucacaagagggagcaguacauaccgcauuagcaggagcucucgaagcugaaauggauggagcaaaaggaagauuaucaagcggacauuuaaaaugcagacuaaaaauggacaaauuaagauuaaaagguguaaguuacagucuauguacugcagcauuuacauucacuaaaauaccagcggaaaccuuacauggaacgguaacaguagaagugcaguacgcugguacggauggacccuguaaagucccugcacaaauggccguagauaugcaaacucuaacaccuguaggacgacuaauuacagcuaauccaguaauaaccgaaagcacagaaaacucuaaaaugauguuagaauuagauccuccuuuuggagauucauacauuguuauaggaguaggcgaaaagaaaaucacacaccauuggcauagauccggaaguacaauaggaaaagcauuugaggccacaguaagaggcgcaaaaagaauggcaguacuaggagacacagccugggauuuugguucuguaggaggagcauuaaacaguuuaggcaaaggaauacaucagauuuucggagcagcauuuaaaucauuauucgggggaaugaguugguuuucacaaauacuuauaggaacacuacuaauguggcuggguuuaaauacuaaaaauggaagcauaucccuaguuugccuagcacuaggaggaguucugauauuucuaucaacagcuguaagugcaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9303 - RNA, 2290 nt, Artificial Sequence
  EU545988.1 prME-short mRNA Design 3 opt
gggagaaagcuuaccaugacgucaguaggaauaguaggguuacuuuuaacgacagcaauggcaguagaaguaacacgaagaggauccgcauauuacauguaucuugaccgaucagaugcaggagaagcaauaaguuucccaacaacacuaggaaugaauaaaugcuauauacaaauaauggauuuaggucacaugugcgaugcaacaauguccuaugaauguccgauguuagaugaagguguggaaccugaugauguagauuguugguguaauacuacaucuacauggguugucuacggcacaugucaucauaagaaaggagaagcgcgaaggaguaggagagcaguaacacuaccgucacacagcacaagaaaauuacaaacuagaucacaaaccugguuggaauccagagaauauacaaaacauuuaaucagaguagaaaauuggauauuuagaaauccaggguuugcuuuagcagcagcagcaauagcaugguuauuaggaaguucaacuagccaaaaaguuaucuaccuaguaaugauucuauuaauagcaccagcguauucaauaagauguauagggguaaguaauagagacuucguagaaggaaugaguggaggaacuuggguagacgugguauuagaacauggaggaugcguaacagugauggcacaagacaaaccagcaguagacauagaauuaguaacaacaacaguaagcaauauggcagaaguaagauccuauuguuaugaagcaucaauaucagauauggcaagcgacucgagauguccgacacaaggagaggcuuaucuagacaaacaaagcgauacccaauauguaugcaaaagaacauuaguagauagaggaugggguaaugguugcggauuauucggaaaaggaucucuagucacaugugcuaaauucgcauguucaaagaaaaugacaggcaaaaguauacaaccagaaaauuuagaauacagaauaauguuaagcguucauggaagucaacauaguggaaugauaguaaacgauacgggacacgaaacggaugaaaauagagcgaaaguggaaauaacaccuaauucaccaagagcagaagcuacacuagguggauuuggaucucuaggacuggacugugaacccaggacaggucuagauuuuagcgaccuauauuacuuaacgaugaauaauaaacauuggcuaguucauaaagaaugguuucaugacauaccauuaccauggcaugcuggagccgacacagguacaccacauuggaauaauaaagaagcauuaguagaguucaaagaugcucaugccaaaaggcagacaguuguuguacuagggucacaagaaggagcaguacauacagcucuagcgggagcacuagaagcagaaauggauggagcaaaagggcgauuaagcucuggacauuuaaaauguagauuaaaaauggauaaauuaagauuaaaaggaguaaguuauucauuaugcacagcggccuuuacauucacaaaaauaccagcagaaacacuacaugggacagugacaguagaaguucaauaugcaggaacagacggaccuugcaaaguuccggcacaaauggcaguugauaugcaaacacuaacaccagugggaagauuaauaacagcaaacccaguuauaacagaaaguacagaaaauagcaaaaugaugcuggaauuagauccaccauuuggugacaguuacauaguuauaggagugggagaaaagaaaauaacacaucauuggcauagaucugggagcacaauuggaaaagcguucgaagccacaguaaggggugcaaaaagaauggcaguauuaggagauacugcaugggauuuuggaucaguagggggugcuuuaaauucauuaggaaaaggaauacaucaaauuuucggugcagcauuuaaaaguuuauuuggaggaaugucaugguucagucaaauccucauuggaaccuuauuagucuggcugggauuaaauacuaaaaacgguucuauaaguuuaaccugucuagcacuaggaggcguauuaauuuucuuaagcacagcaguuagcgcaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9304 - RNA, 2290 nt, Artificial Sequence
  KU681082.3 prME-short mRNA Design 3 opt
gggagaaagcuuaccaugacgucaguagggauagucggauuauuauuaacaacugcuauggcaguugaaguuacaagaagaggaagugcauacuauauguaucuugauagaucagaugcgggugaagcaauaucauuuccuacuacacuuggaaugaacaaauguuauauacaaauaauggaucuaggacauaugugugaugcaacaaugagcuacgaauguccgauguuagacgaaggaguagagccagacgauguagauuguugguguaacacaacaucaacaugggucguuuauggaacgugucaccacaaaaaaggagaagcaagaagaucgcgaagagcaguuacacuaccaagccauaguaccagaaaacuacaaaccagaucacaaacauggcuagaaucacgugaauauacaaaacaucuaauacgaguugaaaauuggauauuuagaaauccagguuuugcacuagcagcagcaguaauagcauggcuacuaggaucgucaacaagucaaaaagucauauacuuagucaugauccuacuaauagcaccagcuuacuccauaagauguauaggaguaagcaacagggauuuuguugaagguaugaguggcggaacauggguugauguuguacuagaacacggggguuguguaaccguuauggcacaagacaaaccaacaguagacauagaacugguaacaacaacaguaucaaauauggcagaaguucgaaguuauuguuaugaagcaaguauuagcgacauggcuagugauucaagauguccaacacaaggugaagcauauuuagauaaacaaucugauacacaauacgucuguaaaagaacacuugucgacagaggauggggaaauggaugugguuuauuuggaaaaggaagccucguaacuugugcuaaauuugcauguaguaaaaaaaugacgggaaaaaguauacaaccagaaaauuuagaauauagaauaauguuaagugugcacggaucacagcauucagguaugauuguaaacgacacaggacaugagacugacgaaaauagagcaaaaguagaaauaacaccgaacagcccuagagcagaagcaacacuuggagguuuuggaucauuaggucuugauugugaaccuagaacagguuuagauuucagcgacuuauauuaucuaacaaugaacaauaaacauugguuagugcacaaagaaugguuucacgacauaccgcugccauggcaugcaggagcagacacaggaacaccucauuggaauaauaaagaagcgcuaguugaauuuaaagaugcacacgcaaaaagacaaacaguaguuguacuaggaagccaagaaggcgcaguucauacagcguuagcaggagcucuagaggcagagauggauggcgcaaaagggagauuaaguaguggacauuugaaauguagacuaaaaauggauaaauuaagauuaaaaggaguaucauauagccuaugcacagcagccuuuacauuuacaaaaauaccagcagaaacauuacauggaacuguaacuguggaaguacaauaugcaggaacagauggcccauguaaaguaccagcacaaauggcugucgacaugcaaacacuaacaccaguuggaagguugauaacugcaaauccagugauuacagaaucaacagaaaauucaaaaaugauguuagaguuagacccaccauuuggagauagcuacauaguaauuggcguaggagaaaaaaaaauuacgcaucauuggcacagaagcggauccacaauaggaaaagcauuugaagcaacaguaagaggagcaaaaaggauggcaguguuaggagauacagcaugggauuuuggaagugucggaggugcucuaaacucauuagguaaagguauacaucaaaucuuuggggcagcauuuaagucgcuauuuggaggaaugagcugguuuagccaaaucuuaauugguacacuacuagucuggcuaggauuaaacacaaaaaaugguucaauaagcuuaaccugucuagcauuagggggcguacuaaucuucuuaucaacagcaguaagugcaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9305 - RNA, 2290 nt, Artificial Sequence
  KX601167.1 prME-short mRNA Design 3 opt
gggagaaagcuuaccaugacaucaguggguaucguaggauuauuacuuacaacagcaauggcaguugaaguaacaaggaggggauccgcauauuauauguacuuagacagaagugacgccggugaagcaauaucauuuccaacaacacuaggaguuaauaaauguuauauacaaauuauggaccuaggacacaugugugaugcaacaauguccuacgaauguccaaugcuagacgaaggaguggaaccagaugauguagauuguugguguaauacaacaaguacauggguaguuuaugggacaugucaucauaagaaaggagaagcacgaagaucaaggagagcugucacauuaccaucacacaguacgagaaaacuacaaacaagaagucaaacauggcuagaaucaagggaauauacuaaacaucuuauaaggguugaaaauuggauauucagaaauccaggauucgcacuagcagcugcagcuauagcguggcuuuuggguaguaguacuagccaaaaagucauauauuugguuaugauucuacuaauugcaccggcauauuccauacguuguauaggaguaucaaauagagacuuuguugaaggaaugucaggaggaaccuggguagauguaguacuagaacacggaggcuguguuacggucauggcacaagauaaaccaacaguagauauagaacugguuacaacaacaguaagcaauauggcugaaguacgaagcuacugcuacgaagcaaguauaucagauauggcaucagacucacgauguccaacacaaggagaagcauauuuagauaaacaaagugauacucaauauguauguaaaagaacucuaguagauagaggaugggggaaugggugcgguuuauucggaaaagguagucuaguuaccugugccaaauuugcaugcucaaagaaaaugacuggaaaaaguauacagccugaaaauuuagaauauagaauaaugcuaucaguacauggaagucaacauuccggaaugauagucaaugauacaggacaugaaacagaugaaaauagagcaaaaguagaaauuacaccaaacaguccaagagcagaagcaacauuaggagguuuugguucauuaggauuagauugcgaacccagaacaggacuagacuuuagugacuuauauuaccuaacaaugaauaauaaacauugguuagugcauaaagaaugguuucaugauauaccauuaccauggcacgcaggagcugauacgggaacaccacacuggaauaauaaagaggcucugguagaauuuaaagaugcacacgcaaaaagacaaacaguaguuguuuuggguagccaagaaggugcaguucacacagcguuggccggagcauuagaggccgaaauggauggugcaaaaggaagacuaucaaguggacaucuaaaauguagacuaaaaauggacaaauuaagauuaaaaggaguaaguuauagccuaugcacagcugcauuuacauucacaaaaauaccagccgaaacauuacauggaacaguaacaguagaaguucaauaugcaggaacagacggaccaugcaaaguaccugcacaaauggcugucgauaugcaaacauuaacuccaguuggaagauugauaacagcaaauccaguaauaacagaaaguaccgaaaacagcaaaaugauguuagaacuugauccaccuuuuggugauaguuauauagugauuggcguaggagauaagaaaauuacacaccauugguauagaucaggaucaacaauaggaaaagcauucgaagcaacuguaagaggagcaaaacgaauggcaguauuaggagacacugcaugggauuuuggaagcguaggaggagcguuaaauucacuaggcaaaggaauacaucaaauauuuggagcagcauuuaaaaguuuguuuggcggaaugagcugguuuagucaaauauuaauaggaacauuauuaguaugguuaggacuaaacacgaaaaauggaucaauaagucuaacauguuuagcucuagguggaguauuaauauuuuuaaguacagcaguaucagcaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9306 - RNA, 2290 nt, Artificial Sequence
  KX694533.2 prME-short mRNA Design 3 opt
gggagaaagcuuaccaugacaucaguuggaauaguuggacuauuacucacuacagcaauggcaguagagguaacacgaagaggcucagcauauuauauguaccuugauaggucagaugccggaaaagcaauuucauuuccaacaacauuagguguaaacaaaugcuauauacaaauaauggaucuaggccauaugugugaugcaacuaugucauaugaaugcccaauguuagaugaaggaguagaaccagaugauguagacuguugguguaauacuacaaguacuuggguaguauauggaacaugucaccauaaaaaaggagaagcaagaagaagcaggagagcagucacauugcccucacauucuacaagaaaauugcaaacgagaagccaaacuugguuggaaucaagagaauacacaaaacacuuaauaagaguagaaaauuggauauuuagaaacccaggauucgcauuggccgcagcagcuauagcaugguuauuaggaucuucuacgucgcaaaagguaauauaucuaguaaugauauuauuaauagcccccgcguauucaauuagauguauuggaguaucaaauagagacuucguagaagggaugucaggaggaacaugggucgauguuguuuuagaacacgguggaugcgucaccguuauggcacaagauaaaccuacagucgauauugaacuaguaacuacuacugucucaaacauggcagaaguucgaaguuauuguuaugaagcaucaauuucagauauggcaucagauaguagauguccaacccaaggagaagcuuauuuagacaaacaaagcgacacacaauauguuuguaaaagaacauuaguugauaggggcuggggaaaugguuguggauuauucggaaaaggaaguuuaguuacaugugcaaaauucgcuuguucuaaaaaaaugacgggaaaaaguauccaaccugagaauuuagaauauagaauaaugcuaucaguacacggaagucaacacagcgggaugauaguaaaugacauaggacaugaaacggaugaaaauagggcuaaaguagaaauaacaccgaacucaccaagagccgaagcaacacuuggugguuucggaucauuaggacuggauugcgaaccaagaacuggauuagacuucagcgaucuauauuacuuaacaaugaauaauaaacacugguuaguacauaaagaaugguuccaugauauaccauuacccuggcaugcaggagcagauacgggaacaccacauuggaauaacaaagaagcccuaguagaauucaaagaugcacaugccaaaagacaaacaguaguaguucuagggagucaagaaggagcaguacauacugcacuagcaggagcauuggaagcagagauggauggagcaaaaggaagauuaucaaguggucauuuaaaaugcagauugaaaauggauaaauuacgauuaaaaggaguaucauacucucuuugcacagcagcauuuacuuucacuaaaauuccagcugaaacucuucauggaacaguaacaguagaaguccaguacgcgggaacagauggaccaugcaaaguaccugcacaaauggcaguagacaugcaaacauuaaccccaguaggaagauuaauaacagcaaacccuguaauaacagaaaguacugaaaacucuaaaaugauguuagaauuagauccaccuuuuggagauucauauauagucauaggaguuggagauaaaaaaauaacacaccacuggcauaggucaggaagcacaauuggaaaagcauuugaagcuaccguaagaggcgcaaaaagaauggcaguauuaggagacacagcaugggauuucgguucuguaggaggugcguuaaacucauuggguaaagggauacaccaaaucuuuggagccgccuuuaagagccuauuuggaggaaugaguugguuuagucaaauacuaauaggaacacuauuaguaugguugggacuaaauacaaaaaauggaagcauaucacuuacauguuuagcauuaggagguguauuaauauuucugucaacugcaguuagcgcaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9307 - RNA, 2290 nt, Artificial Sequence
  KY288905.1 prME-short mRNA Design 3 opt
gggagaaagcuuaccaugacaaguauaggaauuguaggucuacuucucacuacagcaauggcagcugagauaacaagacgggguagugcauacuauauguaccuagacagaagugacgcagguaaagcaauuucauuugcaacuacauuaggcguaaacaaaugucauguacaaauaauggauuuaggacauaugugcgacgcaacaaugucauaugaaugcccuaugcuggaugagggaguugaaccugacgauguagauuguugguguaauacaacaucaacauggguagucuacggaacaugccaucauaagaaaggagaagcaagaagaaguaggagagcagugacacuaccuucucauaguacaagaaaauuacaaacuagaagucaaacauggcuagaaucaagagaauauacaaaacauuuaauaaaaguugaaaauuggauauuuagaaauccaggauuuacauuaguagcuguugcaauagcauggcuauugggaucaaguaccagucaaaaaguuauuuaucuaguaaugaucuuauuaauagccccugcauauagcauacgauguauaggaguuucaaacagagauuuuguagaaggaaugaguggagguaccuggguagauguaguauuagaacauggaggcugcguaacggugauggcucaagauaagccaacaguugauauagaauuaguaacaacaacaguaagcaacauggcagaaguuagaagcuacuguuacgaagcaaguauaagugauauggcaucagauaguagaugcccaacgcaaggagaagccuacuuagauaaacaaagugauacacaauauguaugcaaaagaacauuaguugaucgaggauggggaaacgguugcgguuuauuuggaaaaggaucuuuaguaacuugugcaaaguuuacauguaguaagaaaaugacugguaaaagcauacaaccagaaaaucuagaauauagaauaauguuaucaguacauggaagccaacacagcggaaugauaguuaaugacaccggacacgaaacagacgaaaauagagccaaaguagaaguuacaccaaacaguccucgagcggaagcaacacuaggcggauucggaaguuuaggauuagacugugaaccuagaacaggccuagauuuuagugacuuauacuacuuaacaaugaauaacaaacauugguuaguacacaaagaaugguuccaugacaucccacuaccauggcacgcuggugcagauacuggaacaccacauuggaauaauaaagaagcauuaguagaauuuaaagaugcacaugcuaaaagacaaacaguuguuguuuuaggaucucaagaaggagcaguacauacagcacuagcuggcgcucuggaggcugaaauggauggagcgaaaggaagauuauucucaggacacuuaaaauguagauuaaaaauggauaaauugagacuaaagggaguaaguuauagucuauguacagcagcauuuacguuuacaaaagugccugcagaaacacuacauggaacugucacgguagaaguucaauaugcaggaacugauggaccguguaaaguaccagcacaaauggcaguagauaugcaaacauuaaccccuguaggaagacugauaacagcaaacccgguaauaacagaaaguacagaaaacaguaaaaugauguuagaauuggacccgccauucggagauagcuauauaguaauuggcguaggagauaagaaaauaacucaccauuggcacagaaguggaucaacaauaggaaaagcauucgaagcaacaguaagaggagcaaaacgaauggcaguauugggagauacagcaugggauuuuggaucaguaggaggcguauuuaacucgcuaggaaaagggauacaucaaaucuuuggagcagccuucaaaaguuuauuuggaggaaugagcugguuuagucaaauacuuauaggaacacuauuaguaugguuaggauuaaacacuaaaaacggaaguaucucuuuaacauguuuagcauuaggaggagugaugauauucuuaucgacagcugugagcgcgugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9308 - RNA, 2290 nt, Artificial Sequence
  KF268950.1 prME-short mRNA Design 3 opt
gggagaaagcuuaccaugacaaguauaggaauaauaggucucuuguuaacgacagcuauggcagcagaaauaacaagacgagggagugcauauuauauguaccuagaccguucugacgccggaaaagcuauaucauuugccacaaaccucggaguaaacaagugucauguacaaauaauggaucucggucauaugugugacgcgacuaugaguuaugaauguccaaugcuagaugaaggaguagaaccagacgacguugauugcugguguaauacaacaagcacuuggguaguauauggaacaugucaucacaagaaaggggaggccagaagaucaagacgagcaguaacauuaccaucccacagcacaagaaaauuacaaacaagaagucaaacaugguuagaaaguagagaauauacuaaacauuuaauaaaaguugaaaauuggauuuucagaaauccaggauucgcauuagcagcaguagcaauagccuggcuauuaggaucaucaacuucacaaaaaguaauuuaucuggucaugauauuacuaauagcaccagcauauagcauaagaugcauaggaguaaguaacagagauuuuguagaaggaaugaguggaggaacauggguugaugucguauuagaacauggagguuguguaacuguuauggcgcaagauaaaccaacaguagacaucgaauuaguuacaacaacaguaagcaauauggcugaaguaaggaguuauuguuaugaagcauccauuucggauauggccucagauaguagaugcccuacacaaggagaagcauauuuagauaaacaaucagacacacaauaugucugcaaacgaacucuagucgauagaggaugggguaauggcuguggccuauucgguaaaggaucccuaguaacaugcgcaaaauucacaugcucuaagaaaaugacagggaaaucaauccaaccugaaaauuuggaauaucgaauaauguuaaguguacacgggagucaacacucaggaaugauaguaaaugauauagggcaugaaacagaugaaaacagagcaaaaguagaaguaacgccuaauucaccaagagcugaagcaacacuagguggauuugggaguuuaggauuagacugugaaccaagaacaggauuagauuucucagaccucuacuacuuaacaaugaauaauaaacacuggcuaguacauaaagaaugguuccaugauauuccuuuaccauggcacgcaggagcagauacaggcacaccucauuggaacaauaaagaagcucuaguagaauuuaaagaugcacaugcaaaaagacaaacugugguuguauuagguucacaagaaggagcaguacauacagcacuagcuggcgcauuggaagcagaaauggacggagcaaaagguaggcucuuuaguggacaucuaaaauguagguuaaaaauggacaaacuuagguuaaaaggaguaucauacucacuaugcacugcugcuuucacauucacaaaaguacccgcagaaacauuacacggaacagugacaguugaaguacaauaugcuggaacugauggucccuguaagguaccagcacaaauggccguagauaugcaaacauuaacuccaguagguagacuaauaaccgcaaauccaguaauuacagaauccacagaaaauaguaagaugaugcuagagcuagauccaccauuuggagauaguuauauagucauaggaguaggugacaagaaaaucacacaucacuggcauagaaguggcagcacaauuggaaaagcauuugaagcaacaguaagaggagcaaaaagaauggcaguauuaggugauacagcaugggauuuuggaaguguagguggaguuuuuaauucacuaggaaaaggaguacaucaaauauuuggagccgcuuucaaaucacuauuuggaggaaugaguugguuuucucaaauauuaauaggaacauuauuaguaugguuaggucuaaacacuaaaaauggaucaaucucauuaacauguuuagcacucggaggaguuaugauuuuccuaagcacagcaguaagcgcaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9309 - RNA, 2290 nt, Artificial Sequence
  KF383121.1 prME-short mRNA Design 3 opt
gggagaaagcuuaccaugacuucaauagguauaauaggucuauuacuaacaacagcaauggcugcagaaauaacacgaagaggaucagcuuacuacauguaucuagacagaagugaugcuggaaaagcaauuagcuucgcaacaacacucggaguuaauaaaugccacguucaaauaauggacuuaggacauaugugugaugcaacuaugaguuacgaauguccaaugcuugacgaagguguugaaccagaugauguagacuguugguguaauacgacuagcacguggguaguauacggaacaugucaucauaaaaaaggcgaagcuagaagaagucgacgagcaguuacacuaccgagucacaguacaagaaaacuacaaacacgaucacaaacaugguuagaaaguagagaauauacaaaacaccuaauaaagguugagaauuggaucuucagaaauccgggguucgcucuuguagcaguagccauagcaugguuauuaggaucuagcacaucacaaaaaguaaucuaucuaguuaugauacuuuugauagcaccagcuuauaguauaagauguauuggaguaucaaauagagacuucguagaaggaaugucuggaggaaccuggguagauguaguauuagaacacggcggaugcguuacaguaauggcccaagauaaaccaacaguagacauagaauuaguaaccacgacaguaaguaauauggcggaagugagaaguuauugcuaugaagcaaguauaucagauauggcaucagauucacgaugcccaacacaaggagaagccuauuuagauaaacaaagcgauacacaauacguuugcaaaagaacucuaguagacagaggauggggaaauggauguggauuauucggaaaaggaucuuuaguaaccugugcaaaauuuacaugcaguaaaaaaaugacagguaaaaguauacaaccagaaaauuuagaauauagaaucaugcuuucaguacacggaucacaacauagcgguaugauaguaaacgacauaggacaugaaaccgaugaaaauagggcaaaaguagagguaacaccaaacucaccaagagcagaagcuacuuuaggaggauuuggaucauuaggguuggauugugaaccacgaaccggacuagauuuuagugaucuauacuaucuaacaaugaauaacaaacauugguugguacauaaagaaugguuucacgacauuccucuaccauggcaugcuggugcagauacuggaacaccacauuggaauaauaaagaagcacuaguagaguuuaaagaugcccaugccaaacgacaaacaguaguaguacuaggaagucaagaaggagcaguacauacagcauuagcuggagcauuagaagcggaaauggauggagcaaaaggaagacuauucaguggucaccuaaaauguagauuaaaaauggauaaauuaagauuaaaaggagugucauauucccuaugcacagcggcauucacauuuacgaaaguuccagcagaaacacuccauggaacagugacaguagagguacaauacgcuggaacugaugguccaugcaaaguaccggcacaaauggcgguugauaugcagacauuaacaccaguagggagguuaauaacagcaaauccaguaauuacagaaagcacagaaaacucuaaaaugaugcuagaguuagauccacccuuuggagacaguuacaucguaauaggaguaggagauaaaaaaauaacgcaucauuggcauagaucagguucuacuauuggcaaagcuuuugaggcaacaguaagaggagcaaaaaggauggcagucuuaggugauacggcaugggauuuuggcucuguaggaggaguuuuuaacaguuuagguaaaggaauucaccaaauauuuggagcggcauuuaaaagcuuauuuggaggaaugaguugguuuucacaaauacuuauagguacguuauuagucuggcuuggauuaaacacaaaaaauggaaguauaucacuaacuugcuuagcauuaggaggcguaaugauauuuuuaaguacugcaguaagugcuugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9310 - RNA, 2272 nt, Artificial Sequence
  KF268949.1 prME-short mRNA Design 3 opt
gggagaaagcuuaccaugacaagcauuggaauuauaggacuauuauuaacaaccgcaauggccgcagaaauaacgagacguggaagcgcauacuauauguauuuagaccgaucugaugcaggaaaagcuauuucuuuugcgacaaauuuaggaguuaauaaaugccauguucaaauaauggaucuaggacauaugugugaugcaacaaugucauaugaauguccaauguuagaugaaggaguagaaccagacgacguagauuguuggugcaacacaacaucaacauggguaguauacggaacgugucaccauaagaaaggugaagcaagaagaucuaggagagcaguaacauuaccaucgcauagcacaagaaaacuacaaacaagaagucaaaccuggcuagaaucaagagaauacacaaaacaccucauaaaaguggaaaauuggauauucagaaacccaggauucgcuuuagcagcaguagcaauagcauggcuuuuaggaagcaguacaucccaaaaaguaauauauuuaguuaugauauuauuaauagcuccagcauacucaaucaggugcauaggaguaaguaauagggauuucguugaaggaaugucaggaggaacauggguagacguaguauuagagcacggagguugcguaacgguaauggcacaagacaaaccaacaguggauauagaauuaguaacaacaacuguuaguaauauggcggaaguacgaucauauugcuaugaggccucuauaucagacauggcaucagacagcagaugcccaacccaaggagaggcuuacuuagauaaacaaagugacacacaauacguauguaaaagaacacucguugaucgaggcuggggaaauggaugcggauuauuuggaaaaggaucuuuaguuacaugcgcaaaauuuacauguaguaagaaaaugacagggaaaagcauacaaccagaaaauuuagaauauagaauaaugcuaucuguacauggaucacaacauucagggaugauaguaaacgaugaaaaccgagcaaaagucgaaguaacuccaaauucaccucgagcggaagcaacguuaggugguuucgguaguuuagguuuagauugcgaaccuagaacaggacuggauuucagcgauuuauauuaccuaacuaugaacaauaaacauugguuagugcauaaagaaugguuucacgauauaccacucccauggcacgcaggagcugauacaggaacaccacauuggaauaauaaagaagcucuaguagaauuuaaagaugcacacgcaaaaagacaaacaguagugguacuaggaagucaagaaggagccguacauacagccuuagcaggagcauuagaagcugaaauggauggugcaaaaggaagguuauuuucaggacauuuaaaauguagacucaaaauggauaaauuaagauuaaaagguguaaguuauucacuaugcacagcagcuuuuacauuuacaaaaguaccagcagaaacacuacacgggacagugacaguagaaguacaguacgcaggaacagaugggccauguaaaguaccagcacaaauggcuguagacaugcagacauugacaccgguuggaagauuaauaacagcaaauccaguaauaacugaaaguacugaaaauucaaaaaugaugcuagaacuagacccaccauuuggcgacuccuauauaguuauaggagugggugauaagaaaaucacacaucauuggcauagaucaggaaguacgauaggaaaagcguuugaagccacgguuagaggagcuaaaagaauggcagugcuaggagauacggcuugggauuuuggaaguguaggaggcguguuuaauagccuagggaaaggaauacaucaaauauuuggggcagcuuucaaaagucuauuuggagguaugaguugguuuagucaaauauuaauagguacacuauuaguaugguuaggauugaacacuaaaaaugggagcauuaguuugacuuguuuagcacuaggugguguaaugauauuuuuaucaacagcaguaagugcaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9311 - RNA, 2290 nt, Artificial Sequence
  KU955595.1 prME-short mRNA Design 3 opt
gggagaaagcuuaccaugaccucaauugguauugucggacuacuccuaacaacagcaauggcagcagaaaucacucgaaggggaucggcguacuauauguaucuugauaggagcgacgcaggaaaagcaaucucguuugcuacaacauuaggaguaaacaaaugccauguacaaauaauggauuugggacauaugugcgaugcaacaauguccuaugaguguccuauguuggacgaaggaguugaacccgacgacguagacuguugguguaauacgacaagcacauggguuguauaugguacaugucaucauaaaaaaggugaagcuagaagaucucggcgagcagugacauuaccaucacauucaacaaggaaacuacaaacuagaucacaaacaugguuagaaucacgagaauauacgaaacaucuaaucaaaguagaaaacuggauuuuucguaacccaggauuugcccuuguagcaguagcaauagcauggcuucuaggaucgaguacaucccaaaaaguaauuuauuuaguaaugauacuauuaauagcaccagcauauagcauaagauguauaggaguuaguaacagagacuucgucgaaggaaugucaggcggaacauggguugauguaguccuagaacacggcggauguguaacaguaauggcucaagauaaaccaacaguagauauagaacucgucacgacaacaguaucaaauauggccgaaguaagaaguuauuguuaugaagcgaguauuagugacauggccucagauucaagauguccaacccagggcgaagcauaucuugauaaacaaucugacacacaauauguaugcaaaagaacacuuguagacagaggauggggaaauggaugcggacuauuuggaaaaggaagccuaguaacaugugcaaaauucacuuguucaaaaaagaugacaggaaaaagcauucaaccugaaaacuuagaauaucgaauaauguuaucuguucauggaucacaacauucuggaaugauaguaaaugacacuggacaugaaacugacgaaaacagagcaaaaguagaagucacacccaauucaccaagagcagaagcuacacuaggaggauuugguagucuaggucuagauugugaaccaagaacuggacuagauuucucagacuuauacuaucugacaaugaauaacaaacacugguuaguacauaaggaaugguuucaugacauaccucucccuuggcacgcaggagcagauacagguaccccacauuggaacaauaaagaagcacuaguagaauuuaaagacgcccaugcaaaaagacaaacaguaguagucuuaggaagccaagaaggagcaguacauacagcauuagcaggagcucuagaagccgaaauggacggagcaaaagguagacuauuuucuggucaucuaaaaugccgacuaaaaauggacaaauuaagacuaaaagguguaucauacagcuuaugcacagccgcauuuacauucacuaaagucccagcagaaacauuacacgggacaguaacaguagaaguacaauaugcaggaacagacggaccaugcaaagucccagcacaaauggcaguagacaugcaaacauuaacuccaguaggaagacuaauaacagcuaacccaguuauuacagaaucgacagaaaauucaaaaaugaugcuagaacuugauccaccauuuggugauucauauauaguuauaggaguaggagauaaaaaaauaacacaucauuggcauagaucaggaucaacaauaggaaaagcauuugaagcaacaguaaggggcgccaaaagaauggcaguauuaggagacacagcaugggauuuugguucuguuggagguguauucaauucauuaggaaaaggaauccaccaaauauuuggagccgcauuuaaaucucuauuuggaggaaugucaugguucucacaaauauuaauaggaacauuguuaguauggcuaggauuaaacacgaaaaaugggucaauuagucuaaccugucuagcauugggaggaguaaugauauuucuaucaacagcaguaucagcaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9312 - RNA, 2290 nt, Artificial Sequence
  KF383116.1 prME-short mRNA Design 3 opt
gggagaaagcuuaccaugacaucuaucgguauaguaggauuacuauuaacaacggcaauggccgcagagauaacucgaagaggaucagcguacuauauguacuuagauaggucugacgccggaaaagcaauaaguuuugcuacuacauuaggaguaaauaaaugucacguacaaauaauggaucuaggacauaugugugacgcuacuaugucauaugaaugcccaauguuagaugaaggcguugaaccggaugauguagauuguuggugcaauacuacaucaacauggguaguauauggaacaugucaacauaagaaaggugaagcccgaagaagucggagagcugucacauuaccaucacacucaacaagaaaauuacaaacaagaucacaaacaugguuagaauccagagaauacacaaaacaucuaauaaaaguugagaacuggauuuuuagaaacccaggcuuugcuuuaguagcaguggcaauagcgugguuauugggaaguaguacaagucaaaaagugauauauuuaguaaugauucuauuaauagcuccagcauauaguaucagauguauagguguaucaaauagagauuuuguagaaggaaugagcggaggaaccuggguagaugucguauuagaacauggaggauguguaacuguuauggcacaagacaaaccuaccguagauauagaauuaguaacaacuacuguuaguaauauggcugaagucagaagcuauugcuacgaagcaaguauaagugauauggcaagugauucgagauguccaacucaaggcgaagcauaucuugauaaacaaagcgauacacaauauguauguaaaaggacguugguagauagagguuggggaaacggauguggcuuauucggaaaaggaagucuaguuacuugcgcgaaauuuacauguagcaagaaaaugacagguaaaaguauacaacccgaaaaucuagaauauagaaucauguuaucaguacacggaucacaacauaguggaaugauaguaaaugauauaggacacgaaaccgaugaaaauagagccaaaguugaaguaacgccaaauucgccaagagcugaagcaacauuaggaggauucggaucucuuggauuagauugcgagccaagaacaggauuagacuuuagugauuuauacuaucuaacuaugaauaacaaacauugguuaguacauaaagaaugguuucaugauaucccauuaccuuggcaugcaggagcagauacagggacaccucauuggaauaauaaagaagcauuagucgaguucaaagacgcucaugcaaaaagacaaaccguaguaguacuaggaucacaagaaggagccguacauacggcgcuugcaggagcauuagaagcagaaauggauggagcaaaaggaagauuauuuucuggacauuuaaaauguagauuaaaaauggauaaacugagauuaaaaggaguuucuuauucuuuauguacagcaguuuguacagcagcuaaagucccagcagaaacacuacauggaacaguaacaguagaaguacaauaugcaggaaccgaugguccauguaaaguaccagcucaaauggcagucgauaugcaaacauuaacuccgguaggaagacuaauuacagcuaacccaguaauaacagagucaaccgaaaauagcaaaaugauguuagaauuagauccaccauuuggagauagcuacauuguaauaggaguuggagauaagaaaauaacacaucauuggcauagaucgggaagcaccauugggaaagcauucgaagcgacagugaggggagcaaaaagaauggcaguauuaggagauacagcgugggauuuuggaucuguaggaggaguauuuaauaguuugggaaaaggaauacaucaaauauuuggagcagcauuuaaaucauuauuuggaggaaugagcugguuuucacaaauauuaauaggcacacuauuggucuggcucggacugaauacuaaaaacggaaguauuaguuuaacgugccuagcauuaggaggcguaaugauauuccuuaguacagcaguuucagcaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9313 - RNA, 2272 nt, Artificial Sequence
  KX601166.1 prME-short mRNA Design 3 opt
gggagaaagcuuaccaugaccucaauaggaauaguaggcuuguuguuaacaacagcaauggcagccgaaauuacaagaagagguuccgcauauuauauguaccuagauagaucagaugcagggaaagcaauaaguuuugcaacaacuuuaggagucaauaaaugucauguacaaauaauggauuugggacauaugugugaugcaacaaugagcuacgaauguccaauguuagaugaaggaguugaaccugacgauguagauuguugguguaauacaacaaguacauggguaguauacggaaccugucaucauaaaaaaggagaagcucgaagaagcagaagggcuguaacacuaccgucucauagcacuagaaaauuacaaacacgaucccaaacauggcuagaaaguagagaauacacaaaacauuuaauaaaaguagaaaauuggauauuuagaaaucccggauucgcuuuaguagccguagcaauugcaugguuauuaggaucaucuacaucacaaaaaguaauauaucuuguaaugauacuauuaauagcgccggcauauaguauuagaugcauaggaguaaguaauagagauuuuguagaaggaaugaguggugguacguggguagaugucguucuagaacacggaggaugcguaacaguaauggcacaagacaaaccgaccguagacauagaauuaguuacaacuaccguuucaaacauggccgaagugagaucuuacuguuaugaagcuucaauaagugauauggcaucagauucaagaugcccuacacaaggagaagcguaccuugacaaacaaucggauacacaauauguaugcaaaagaacacuaguagaucgaggauggggaaacgguuguggacuguuuggaaaaggaaguuugguaacuugugcaaaauuuacauguucaaaaaaaaugacagguaagucaauacaaccagaaaaccuugaguauagaauaaugcuaucaguacauggaagucagcacucaggaaugauaguaaaugacgaaaacagagccaaaguagaaguuacucccaauaguccacgagcggaagcaacauugggaggguuuggaucucuaggucuagauugcgaaccgagaaccggauuagauuucagugauuuauauuauuuaacaaugaauaauaaacacugguuaguucacaaagaaugguuccacgauaucccauuaccauggcaugcuggagcggauacgggcacaccacauuggaauaacaaagaagcacuaguugaauuuaaagaugcacaugcaaaacgucaaacaguaguaguauuaggaucccaagaaggcgcuguacauacagcacuagcaggugcauuagaagcugaaauggauggugcuaaaggacgcuuauuuucaggacaucuaaaaugucgucuaaaaauggacaaauuaagacuuaaaggaguaaguuauagcuuauguacugcagcauuuacuuuuacaaaaguaccagcugaaacauuacacggaacagugacaguugaaguacaauaugcugggacagacggaccauguaaaguaccagcccaaauggcaguagauaugcaaacauuaacgccuguaggucguuuaauaacugcuaacccugucauaacggaaucaacagaaaauucaaaaaugauguuagaauuagauccaccuuucggagacucauacauaguaauaggaguuggagacaagaaaauaacucaccacuggcauagaucaggaaguacgauugguaaagcauuugaagcaacggugagaggagcaaaaagaauggcaguauuaggggauacagcgugggauuuuggaaguguaggaggaguuuuuaacucauuaggaaaagguauacaccaaauauuuggugcagcauuuaaaucucuauuuggagguaugucaugguuuucacaaauauuaauagguacacuauuaguaugguugggacuaaauacaaaaaauggaucaauaucucuaacaugcuuagcuuuaggaggaguaaugauauuuuuaaguacagcagugucagcaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9314 - RNA, 2290 nt, Artificial Sequence
  KF383118.1 prME-short mRNA Design 3 opt
gggagaaagcuuaccaugacuucaauaggaauaaucggguuacuauuaacaaccgcaauggcagcugaaauaacccgaagaggaucagcauacuauauguaccuagauagaucagacgcaggaaaagcaauaagcuuugcaacgacgcucggaguaaacaaaugucauguccaaauaauggauuugggacacaugugugacgcaacuaugucauacgaauguccaaugcuugaugaaggaguagaaccagaugauguagauuguugguguaacacaacuucaacauggguaguauacggaacuugucaucauaagaaaggagaaaccagacgaagccgaaggucaguuagucuaagauaucacuacacaagaaaacuacaaaccagaucacaaacauggcuagaaucaagagaauauaaaaaacacuuaauuaugguagagaauuggauauuucguaauccagguuuugcaauagugaguguagcaauuacuuggcuuaugggaaguuuaacuagucaaaaaguuauauauuuaguaaugauaguacuaaucguaccagcauacagcauaucaugcauaggaguuaguaacagagaucuaguugaaggaaugucaggaggaacuuggguagacguuguauuagaacacggaggauguguaacagaaauggcgcaagacaaaccgacagucgauauagaauugguaacaaugacaguaagcaauauggcagaaguaagaucauauuguuaugaagcaucacuaucugacauggcaucggcaucacgaugcccaacacaaggugaaccaaguuuagauaaacaaagugauacacaaagcguuuguaaaagaacauuaggugauagagguuggggaaacgguuguggaauauuuggaaaaggaucacucguaacauguucuaaauuuaccuguuguaaaaaaaugccaggaaaauccauucaacccgaaaauuuggaauauagaauaaugcugcccguacauggaagucaacauaguggaaugauaguaaaugauauaggacaugaaacagaugaaaaucgugcaaaaguugaaguaacaccaaauucaccuagagcagaagcaacguuaggaggauuuggaagucuaggcuuagauugugaaccaagaacaggauuagauuuuuccgauuuauauuaucuaacaaugaauaacaaacacugguuaguacauaaagaaugguuucaugauauaccauuaccauggcaugcgggagcugacacuggaacaccacauuggaacaauaaggaagcgcuuguagaauucaaagaugcacacgcaaaaagacaaacaguaguaguacuaggaucacaagaaggagcaguacauacagcauuagccggagcacuagaagcagaaauggacggagcaaaagguagacuauucaguggucauuuaaaaugcagguuaaaaauggauaaacuccguuuaaaaggaguuucuuauaguuuauguacagcagcauuuacauuuacuaaaguaccugcagaaacauuacauggaacaguaacuguagaaguacaaucagccggaacagauggaccuugcaaaguaccugcacaaauggcaguagauaugcaaacacuaacaccgguaggaagacuaauaacagcaaaccccguaauaacugaaucaacagaaaacucuaaaaugaugcuagaacuagauccuccuuuuggugacucauauaucgugauaggcguaggagauaaaaaaaucacacaucacuggcacagaucaggaucuaccauaggaaaagccuucgaagcaacaguaagaggagcaaaaaggauggcaguguuaggcgauacagcuugggauuuuggcagcguaggcggaguauuuaacucacuuggaaaaggaauacaucaaauauuuggcgcagcauucaaaucccuauuuggaggaaugaguugguuuucacaaauauuaauagguacauuacuuguaugguuagguuuaaauacaaaaaacggcucaaucaguuuaacuugccuagcuuuaggaggaguaaugauauuucuaagcacagcagugagcgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9315 - RNA, 2287 nt, Artificial Sequence
  KX447520.1 prME-short mRNA Design 3 opt
gggagaaagcuuaccaugaguguuggaauaguaggauuauuacuuacaacagcuauggcagcagaggucacaagacgaggaucagcuuacuauauguauuuagacaggaaugaugcuggugaagcaauaucauucccgaccacccuggguaugaacaaauguuacauacaaauuauggaucuuggacacaugugugacgcaacuaugucauaugaauguccaaugcuagaugaaggaguagaaccagacgauguagacugcuggugcaacacaacaagcacuuggguaguauauggcaccugucaucauaaaaaaggagaagcuagaagaaguagaagagcaguaacauuaccaagccauuccacuagaaaauuacaaacaagaucacaaacaugguuagaauccagggaauauacaaagcaccucauaagagucgaaaauuggauauuuagaaacccaggauucgcccuugcagccgcagcaauagccugguuacuuggaucgagcacaagucaaaaaguuaucuaucucguaaugauauuauuaauagcaccagcauauagcauacgauguauuggcguaucgaauagagauuuuguagaaggaaugagcggaggaacauggguagacgucguucuagaacaugguggaugcguaacaguaauggcacaagauaaaccuacaguugauauagaauuaguaacaacaacaguaaguaauauggcagaaguaaggagcuauugcuacgaagcaucaaucagugauauggcauccgauucaagauguccaacacaaggagaagcauacuuagauaaacaaucagauacacaauauguauguaaacguacacuuguagacagaggauggggaaacggauguggucuauucggaaaggguagccuaguaacaugcgcaaaauucgcaugcaguaaaaaaaugacugguaaaagcauacaaccagaaaaucuugaauauagaauaauguuaucaguacauggaagucaacauucugggaugauaguuaaugauaccggacaugaaacugaugaaaacagagcaaaaguugaaauuacuccaaauucaccaagagcagaagcaacauuagguggcuuuggaaguuugggacuugauugcgaaccuagaacaggacuagacuuuagugauuuguauuacuuaaccaugaacaauaaacauugguuaguacauaaagaaugguuccaugacauuccauuacccuggcaugcuggagcggauaccgggacaccacauuggaacaacaaagaagcauuaguagaauuuaaagacgcacacgccaaaagacaaacuguaguaguacugggaagccaagaaggagcaguacauacagcgcuagcaggagcauuagaagcagaaauggauggugcaaaaggaagauuaagcucaggucauuuaaaaugcagacuaaaaauggacaaacuuagauuaaaagguguaaguuauucacuauguacugcagcuuucacauuuacuaaaauaccagcagaaacacuacauggcacaguuacuguagaaguccaauacgcaggaacagauggaccuuguaaaguucccgcacagauggccguagauaugcaaacacuuacuccaguaggccgacuuauaacagcaaacccuguaauaacagaaucaacagaaaauuccaaaaugauguuggaauuagaccccccguuuggugauaguuacauaguaauaggagucggggaaaaaaaaauaacccaucacuggcaucgauccggcagcacaauaggaaaagcauuugaagccacuguaagaggagcaaaaagaauggcgguauuaggagauacagcaugggauuuuggaagcguagguggcgcacuaaauuccuuaggaaaagguauacaucaaauauuuggagcugcauuuaaaucucuuuuugggggaaugucaugguuuagucaaauuuuaauaggaacucuauuaaugugguuaggucucaauacaaaaaacggaucaauaaguuuaauguguuuagcuuugggaggaguccuaauauuuuuaagcacggcuguaagcgcaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9316 - RNA, 2290 nt, Artificial Sequence
  KU761561.1 prME-short mRNA Design 3 opt
gggagaaagcuuaccaugacaucaguagguauaguaggacuacuguuaacaacagcaauggcagcagaaguaacuagaagaggaucggcauauuauauguaucuugaccggaaugaugcgggagaagcuauaagcuuuccaacuacuuuaggcaugaauaaauguuauauccaaauaauggaucuaggacauaugugugacgcaacaaugaguuacgaauguccaauguuagacgaagggguagagccugaugacguagauugcuggugcaacacgacaaguacaugggucgucuauggaacaugucaucauaaaaaaggagaagcacgaagaaguaggcgagcaguaacucuucccucacacaguacacgaaaauuacaaacaagaagucaaacaugguuagaaucccgagaguauacaaaacacuugauaagaguagaaaauuggauuuuuagaaauccaggauuugcacuagcagccgcagcaaucgcauggcuacuuggaagcaguacaagucaaaaagucauuuauuuagucaugauauuauuaauugcaccugcauauucaauaagaugcaucggagugucgaauagagauuuuguagaaggaaugaguggaggaacauggguagauguaguauuagaacauggaggcuguguaacugucauggcccaagauaaacccacaguagauauagaauuaguaacgacaacaguaucaaauauggcagaaguaagaucauacuguuaugaggcuaguauuucagacauggcaagugauucuagaugucccacgcaaggugaagcauaucuagacaagcaaucagauacacaauauguauguaaaaggacauuaguggaucgaggcuggggaaaugguuguggacuuuuugggaaagguucauuagucacaugugcaaaauuugcguguucaaaaaaaaugacaggaaaaaguauccaaccagaaaacuuagaauacagaauaaugcuaucuguacacggaucucaacauaguggcaugauaguaaaugauacgggacaugaaacugacgaaaacagagcaaaaguagaaauaacaccaaacucaccuagagccgaagcaacauuaggcggauuuggaucucuaggauuagauugcgaaccaagaacuggauuagauuucucagauuuauauuaucuaacaaugaauaacaaacauugguugguacauaaagaaugguuucacgacaucccauuaccauggcaugcaggagccgauacuggaacaccacauuggaacaauaaagaagcacuuguugaauuuaaagaugcacacgcaaaacgacaaacuguuguaguucuaggaucgcaagaaggugccguacauacagcgcuugcaggagcacucgaagcagaaauggauggcgcaaaaggaagauuaaguucagggcaucuuaaaugcagacuaaaaauggauaaauuaagguuaaaaggaguuucauauaguuuaugcacagcagcauuuacauuuacuaaaauaccagcggaaacauugcacggaacagugaccguagaagugcaauaugccggaacagacggucccuguaaaguaccagcucaaauggcuguagacaugcaaacguuaacuccagucggaagauuaaucacagcgaacccaguaauaacagaaaguacagaaaauucaaaaaugauguuagaauuagacccaccauuuggugauagcuauauaguaauaggaguaggugaaaaaaaaauaacccaucauuggcauaggucuggaaguacaauagguaaagcauucgaagcaacaguaagaggagcuagaagaauggcuguauugggagauacugcgugggacuuuggaucaguagggggagcccuuaauucacuaggaaaaggaauacaucaaauuuuuggagcagcauucaaaucacuauuuggagguaugucaugguuuagccaaauucuaauaggaacauuauuaauguggcuuggauuaaacacaaaaaauggaaguauuucacuaaugugccuagcacucgguggaguguuaaucuuuuuaucaacagcaguaucugcgugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9317 - RNA, 2290 nt, Artificial Sequence
  KX806557.2 prME-short mRNA Design 3 opt
gggagaaagcuuaccaugacuucaguagguauaguaggauuacuuuuaacuaccgcgauggcagcagaaguaacaagaagagggucagcuuauuacauguacuuagacagaaaugaugcaggagaagcaaucaguuucccaacuacauuagguaugaacaaauguuacauccaaauuauggauuuaggacauaugugugacgcaacaauguccuacgaauguccaauguuagaugaaggaguugaacccgaugacgucgacuguuggugcaauacaacaaguacuuggguagucuaugggacaugccaucauaagaaaggagaagcgagaagaagucgacgagcaguaacacuaccaucucauaguacaagaaaauuacaaacacgaagucaaacauggcuagaaucuagagaauauacaaaacaucuaaucagaguagaaaauuggauguuucgaaauccuggauuugcacuagccgcagcagcaauagcauggcuauuaggaucaucaacaucacaaaaaguaauuuacuuaguaaugauuuuguuaauagcuccugcauauaguauaagaugcauaggaguaucaaacagagauuuuguagaaggaaugucaggagguacauggguagauguaguuuuagaacauggcggauguguaacaguuauggcacaagauaaaccaacuguagauauagaauuaguaacaacuacaguaucuaacauggcugaaguuagaucguacuguuacgaagcaagcauuucugacauggcaucagauucuagauguccuacacaaggagaagcauaucuugauaaacagucagauacacaauacguauguaaaagaacauuaguagauaggggauggggaaauggaugcggucuauuugggaaaggaucguuaguuacaugugcaaaauucgcauguaguaagaaaaugacaggcaaaucaauacaacccgagaaccuugaauauagaauaauguuaagcguucauggaucccaacacagcggaaugauagucaacgauaccggucacgaaacugaugaaaaccgugcaaaaguagagauaacuccaaacucaccacgugcagaagcaacauuaggagguuuuggcucucuaggacucgacugugaacccagaacuggucuagacuuuucagaucuauauuauuugacaaugaauaacaaacauuggcugguucauaaagaaugguuccaugauauaccauuaccauggcaugccggagcagauacaggaacuccgcacuggaacaauaaagaggcuuuaguagaauuuaaagaugcccaugcaaaacgacaaacaguaguuguauuaggaagucaagaaggugcaguucacacagcucuggcaggagcauuagaggcagaaauggacggcgcuaaagguagauuaucauccggacauuuaaaauguagauuaaaaauggauaaauuaagauuaaaagguguaagcuauagccuaugcacugcugcauuuacauucacaaaaauaccagcagaaacauuacauggaacaguuacgguugaaguucaauaugcagguacugacggaccauguaagguaccugcacaaauggcaguggauaugcaaacauugacucccguugguagguuaauaacagcaaauccagucauaacugaaucaacagaaaauucaaaaaugaugcuagaauuagauccuccauuuggagacaguuacauaguaauaggaguaggugaaaagaaaauaacacaucauuggcacagaagcggaaguacuaucggaaaagccuuugaagccacgguuagaggugcaaaaagaauggcgguauugggagauacagcaugggacuucggcaguguaggaggagcuuuaaauucauuaggaaaaggaauacaccaaauauucggagcugcauuuaaaagccucuucggagguaugucaugguuuucccaaauucuaauaggaacacuacuaaugugguuaggacuaaauacuaaaaauggaucaauaucacuaaugugcuuagcacucggaggaguacuaaucuuccuaucaacagcaguaagugcaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9318 - RNA, 2290 nt, Artificial Sequence
  LC191864.1 prME-short mRNA Design 3 opt
gggagaaagcuuaccaugacaaguguagguauaguaggacuauuauuaacaacagcuauggcagcagaaguaacgcggagagggucagcguauuauauguaucucgauagaaacgaugccggagaagcaauaagcuuuccaacaacauugggaaugaauaaauguuauauacaaauaauggauuuaggacauaugugugaugcaaccaugucauacgagugcccaauguuagaugaagguguagaaccagaugauguugauuguuggugcaacaugacaaguacauggguagucuauggaacaugucaucacaaaaaaggagaagcaagaagaucaagaagagcaguaacacuacccucccauucaacgagaaaacuucaaacaaggagucaaacaugguuagaaucccgagaauacacaaaacaucuaauaagaguagaaaauuggauauuucgaaauccagguuuugcucuagcugcagcagcgauagcaugguuacuuggaagcucuaccucacaaaaaguaauauauuuaguuaugauucuacuaauagcaccagcauauucaauaagaugcauaggaguaucaaaucgagauuuugucgaaggaaugucaggaggaacauggguagauguuguccuagaacauggaggguguguuacuguaauggcacaagauaaaccuacaguagacauagaacuuguaacaacaacaguaucaaauauggcugaaguucguucauauuguuaugaagcuaguauaagcgacauggccagcgauucaagauguccaacacaaggagaagcauacuuagauaaacaaagugauacacaauauguaugcaaacgaacucuuguugauagaggaugggguaaugguugcggauuauuuggaaaaggaucacuuguaacaugugcaaaauuugcauguaguaagaaaaugacgggcaaaucaauacaacccgaaaauuuggaauauagaauaauguuaaguguucauggaagccaacacucaggaaugauaguaaaugauacaggacaugaaacagaugaaaaucgagcaaaaguagaaauaaccccuaacagcccacgagcagaagcaacguuaggaggauuuggaucacuaggccuagauugugaaccacgaacuggacuugacuuuagcgauuuauacuaccugacuaugaacaacaaacacugguuaguacauaaagaaugguuucaugacauaccacuuccuuggcaugcaggugcagauacaggaacaccacauuggaauaauaaagaagcuuuaguagaauuuaaagaugcgcaugcaaaacgccaaacaguuguaguauuaggcucccaagaaggagcgguacauaccgcccucgcaggagcauuagaagcagaaauggauggagccaaagguagauuaucaucuggccauuuaaaauguagguuaaaaauggacaaauuacgauuaaaagguguaaguuauucauuaugcacagcugcauucacauucacaaaaauuccagcagaaacauuacacggaacaguaacaguugaaguucaauacgcgggaaccgacggaccauguaagguaccagcccaaauggccguagacaugcaaacauuaacaccaguaggaagauuaauaacagcuaauccaguaauaaccgaaagcacagaaaauucaaaaaugauguuagaauuagauccuccauuuggagauucguauaucgugauugggguaggagaaaaaaaaauuacacaccacuggcauagaucaggcucaaccauaggaaaagcauuugaagcuacuguaagaggugcuaaaagaauggcaguucucggugacaccgcaugggacuuuggaaguguagguggugcauuaaauucauuaggaaaaggaauccaccaaauauuuggagcagcauuuaaaucguuauucggaggcaugucaugguuuagucaaauauuaauagguacuuuauuaaugugguuaggacuaaauacaaaaaaugguaguauaaguuuaauguguuuagcucuaggaggaguauugauauucuuaucaacugcaguuagcgcuugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9319 - RNA, 2290 nt, Artificial Sequence
  KU744693.1 prME-short mRNA Design 3 opt
gggagaaagcuuaccaugaccagcguaggaauaguuggucuauuacuaacaacagcuauggcagcagaaguaacaagaaggggaucagcauauuauauguauuuagaucgaaaugaugcuggagaagccauaucuuuucccacaacacuaggaaugaacaaaugcuauauacaaauuauggauuuaggucauaugugugaugcaacaaugucauacgaauguccuauguuagaugaaggaguagaaccggaugauguagauuguugguguaauacaaccucaacauggguagucuacgguacuugucaucauaaaaaaggugaagcaagaaggaguaggagagcgguaacuuuaccaucgcauucaacaaggaaacuucaaacaagaagucaaacauggcuagaaaguagagaauauacaaaacaucucauaagaguugaaaacuggauauucagaaauccuggcuuugcuuuggcugcagcagcaauagcgugguuacuagggucaucaacaucgcaaaaaguuauauaccugguuaugauauuauuaauagcaccggcauauaguauuagauguauaggaguaucaaauagagauuuuguugaaggaaugagcggcggaacauggguagacguuguucuagaacauggaggaugcguaacagcuauggcucaagauaaaccgacaguagacauagaauuaguaacaacuacaguuagcaauauggcugaagucaggucauacuguuacgaagccagcauaagugauauggcuagcgacaguagaugucccacucaaggagaagcauaucuagauaaacaaagcgauacacaauauguguguaaacguacauuaguagacagaggauggggcaauggaugcggauuauuuggaaaagguagucuaguaacaugugcaaaauuugccugcagcaaaaaaaugacaggaaaaaguauacaaccagaaaacuuagaauaccgaauaauguuaucaguacaugguagucaacacaguggaauguuaguaaacgauacaggucaugaaacagaugaaaaucgugcaaaaguagaaauaacaccaaauucgccaagggcagaagcaacucuaggaggauuuggaucacuagguuuggauugugaaccaaggacaggacuagauuuuucagauuuauauuaucuaacuaugaauaauaaacauugguuagcacauaaagaaugguuucacgauauaccauuaccauggcacgcgggagcagcaacuggcacaccacauuggaauaauaaagaagcauuaguagaauucaaagaugcacacgcaaaaaggcaaacuguaguaguacuaggcucacaagaaggagccguacauaccgccuuagcaggagcauuagaagcugaaauggauggagcaaaaggaagauuaucuucuggacaucuaaaaugucgauuaaaaauggauaaacuaagauugaaaggaguaagcuacuccuuguguacagcugcauuuacauuuacaaagaucccagcugaaacaguugauggaacuguaacuguagaaggacaguauggaggaacagaugggccuuguaaaguuccagcacaaauggccguagauaugcaaacguuaacuccuguuggaagacuaauaacagcaaauccgguaaucacagaaagcacagaaaauagcaaaaugauguuagaauuagacccaccuuuuggagauucauauauaguaauugguguaggagaaaaaaaaauaacacaccacuggcauagaucuggaaguacaauaggaaaagcauuugaagcaaccguaaggggagcgaaaagaauggcaguucuaggcgauacagccugggacuuuggaagcgucggaggcgcauuaaauaguuuaggaaaaggaauacaucaaauuauaggagcugccuucaaaucauuauucggaggcaugucuugguuuagucagauauuaaucgguacauuacuaaugugguuaggauuaaauacaaaaaacgguagcauaucauuaaugugucuagcguuaggaggaguuuuaauuuuucuaaguacagcaguaucagggugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9320 - RNA, 2281 nt, Artificial Sequence
  KU963574.2 prME-short mRNA Design 3 opt
gggagaaagcuuaccaugggggcagacgcuucuauaggaauaguaagccuauuauuaacuacuguuauggcagcagaaauaacaagaagggguagugccuauuauauguauuuagacagaagugaugcaggaaaagcaauaaguuuugucacaacuuuaggaguaaauaaaugucacguucaaauaauggauuuaggacauaugugcgaugcgacaaugaguuaugaauguccuauguuagaugaaggcguagaaccagaugacguagauuguugguguaauaccacaucaacuuggguuguauauggaacuugucaucacaaaaaaggagaagcgagaagaucaaggagagcaguaacauuaccaagucauucaacaagaaaacuucaaacaagaagccaaacaugguuagaaaguagagaguacacuaaacaucuaauaaaaguagaaaauuggauauuuagaaauccagguuuugcacuaguugcagucgcuauagccuggcuacuaggaucaucuacaagccaaaaaguaaucuaucuaguaaugaucuuacuaauagcaccagcauauaguauaagauguauuggaguaagcaauagagauuuuguagaaggaaugagcggaggaacuuggguugacguaguauuagaacauggcgguugcguuacagucauggcacaagauaaaccaacaguagauauugaacuagugacaacaacagugagcaauauggcagaaguaagaucguauuguuaugaagcaucaauaucugauauggcuucugauagcagaugccccacacaaggugaagcauauuuagacaaacaaagugacacacaauauguauguaaaagaacauuaguagacagaggauggggaaacggauguggauuguuuggaaaagguaguuuaguuacaugugcaaaauucacuuguucaaaaaaaaugacaggaaaaucuauccaaccagaaaauuuagaauacagaauuaugcuaaguguucauggaagucaacacucgggaaugauagucaaugacgaaaacagggccaaaguugaaguuacgccaaacucaccuagagcagaagccacacuaggaggauuuggaucacuaggacuugacugugaacccagaacgggacuagauuuuagugauuuauauuaucuuacaaugaauaacaaacauuggcuaguacacaaagaaugguuucaugacauaccacuacccuggcacaguggugcagauaccgaaacaccacauuggaacaauaaagaagcacuaguagaauucaaagaugcacaugcaaagagacagaccgugguuguacuagggagccaggaaggagcaguacacacggcauuagcgggagcauuagaagcagaaauggacggagcgaaaggaagauuaucaagcggacaucuaaaauguagauuaaaaauggauaaauugagauuaaaaggaguuucauacaguuuauguaccgcugcauuuacuuuuacuaaaguucccgcugaaacgcuacacggaacaguaacaguagaaguucaauaugccggaagagacggucccuguaaaguacccgcacaaauggccguagauaugcaaacacuaacaccggugggaagacuaauaaccgccaacccaguuauuacagaaucaacagagaauucaaaaaugauguuagaauuagaucccccauuuggugauucuuauauaguaauaggaguaggugauaaaaaaauaacccaccacuggcauaggagcggaucaauaauaggcaaagcauucgaagcaacaguccgaggagcaaaaagaauggcaguacuuggugauaccgcaugggacuuuggaaguguaggaggaguauuuaauagucuagguaaaggaauucaucaaauuuuuggagcggcuuuuaagucauuauucggaggaauguccugguucagucaaauccuaauaggaaccuugcuaguaugguuaggauuaaauacaaaaaauggcucaauuucauuaacaugucuagcacuuggcggaguaaugauauuuuuauccacugcaguaucggcaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9321 - RNA, 2299 nt, Artificial Sequence
  KF383120.1 prME-short mRNA Design 3 opt
gggagaaagcuuaccaugggagccgacacuaguauaggaauaauaggauuauuauuaacuacagcaauggcggcugaaauaacucgaagaggaucagcauauuauauguauuuagauagaucagaugcuggaaaagcaauaaguuuugcaacaacaaugggaguaaacaaaugccauguacagauuauggaucuaggucacaugugugaugcuacaaugaguuaugaaugcccaauguuagaugagggaguagaaccagaugauguggauuguugguguaauacaacgucaacauggguuguauauggaacaugucaccacaaaaaaggagaagcaaggccgucaagacgagcaguaacauuaccuagucauaguaccagaaaacuacaaacuagaagccaaacaugguuagaaaguagagaauauacaaaacacuuaauaaaaguggaaaauuggauacuaaggaauccaggcuuuacuguagcggcauuagcuauggcauggcuacuugggaauucaacaucacaacgaguaauauauuuaguaaugauauuacuaauagcgccugcauauuccauaagaugcauuggaguaagcaaccgcgacuuuguagagggaaugucaggcggaacuuggguugauguaguauuagaacacgguggauguguaacuguaauggcacaagacaaaccuacaguagacauugaauuaguuacgacaacaguaagcaauauggcagaaguacguuccuauuguuaugaagcuaguauaucagauauggcaagcgauucuagauguccuacacagggagaagcauauuuagacaaacaaagugauacacaauacguaugcaaacgcacccuaguagaucgaggauggggaaacgggugcggauuauuugguaaaggaucauugguuacuugcgcgaaauuuacauguaguaaaaaaaugacaggaaaaucaauucaaccugaaaauuuagaauaucgaauaaugcugucaguacauggaucacaacauaguggcaugauagucaaugauauaggacaugaaacagaugaaaacagggccaaaguagaagucacccccaauucccccagagcagaagcgacauuaggcggcuuuggaaguuuaggauuagauugcgaacccagaacaggauuagauuuuucugauuuauauuaucuaacaaugaacaacaaacacugguuaguacacaaagaaugguuucacgacauaccccuaccguggcaugcaggagcagauaccggaacaccacauuggaauaauaaagaagcauuaguagaauuuaaagaugcucacgcaaaaagacaaacaguuguaguauuaggaucucaagaaggugcuguacauacagcacuugcaggagcauuagaagcagaaauggauggagcaaaaggaagauuauuuuccggacaccuuaaaugcagaauaaaaauggacaagcuaagauuaaagggaguaaguuauucacuauguacugcagcuuuuacauuuaguaaaguaccagcagaaacuuuacaugguaccguaacuguugaaguucaauaugcaggaagggaugggccaugcaaaguaccugcccaaauggcaguagauaugcaaacuuuaacgccuguagguagauuaauuaccgcaaauccuauuauuacagaaucaacugaaaauagccgcaugauguuagaacuagauccgccauuuggugauagcuauauaguuauaggaguaggagauaaaaaaauaacacaucauuggcauagaaguggaucaaccauaggcaaagcauuugaagcaacaguaagaggagcgaaaagaauggcaguacuaggcgauacugcaugggacuuuggaucaguagguggaguauucaauucauuaggaaaaggaguacaucaagucuuuggagcugcuuucaaaaguuuauuuggagggaugucaugguuuagccaaauauuaauugggacuuuauuaguuuggcugggauuaaauacaaaaaauggaaguauaucauuagcuugucuugcacuaggaggagcaaugauauuccuaagcacagcuguaucagcaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9322 - RNA, 1582 nt, Artificial Sequence
  KU321639.1 solE mRNA Design 3 opt
gggagaaagcuuaccaugucacaaaaaguaauauauuuaguaaugauacuauuaauagcaccagcuuauagcauaagauguauaggaguuucaaacagggauuucgucgaaggaaugagugguggaacauggguagauauaguucuagaacauggagguuguguaacagugauggcacaagauaaaccaacuguagauauagaauuaguuacuacaaccguaucaaauauggcagaaguuagaucauauuguuaugaagcaucaauaagugauauggccucagauucaagauguccaacacagggggaagccuacuuagauaaacaaucagauacucaauauguauguaaaagaacauuaguagauagagguuggggaaauggauguggauuauuuggaaaagguaguuuaguaacgugugcaaaauucgcauguucuaaaaaaaugacaggaaaaaguauacaaccugaaaaccuagaauauagaauaaugcuaucaguacaugguagucaacauucgggaaugauaguaaaugauacaggacaugaaacagacgaaaauagagcaaaaguugaaauaaccccaaauaguccaagagcagaagcaacauuaggaggauuuggaucauuaggacuagauugcgaaccaagaacaggauuagauuuuagugauuuauauuaucuaacaaugaauaauaaacacugguuaguacauaaagaaugguuccaugauauaccacuaccauggcacgcaggugcagauacaggaacaccacauuggaauaauaaagaagcauuaguugaauucaaagacgcccaugcaaaaagacaaacaguaguaguacuugguagucaagaaggugcuguucacacagcauuggcaggagcauuagaagcagaaauggauggagcuaaaggaagauuaucaucaggacauuuaaaaugcagauuaaaaauggauaaacuaagacuaaaaggaguaaguuauagucuaugcacggcggcauuuacauucacuaaaauaccagcggaaacacuacaugggacaguaacaguagaaguacaauaugcaggaacagauggaccuuguaaaguuccagcucaaauggcaguagauaugcaaacauuaacaccgguagguagauuaauaacagcuaacccaguaauaacagaaaguacugaaaauucaaaaaugaugcuagaacuagauccaccauuuggagacucauauauaguaauaggaguaggagaaaaaaaaauaacucaucauuggcacagaucaggaaguacaauaggaaaggcauucgaagcaacaguaagaggagcuaaaagaauggcaguuuuaggagauacagcaugggauuuuggaagcugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9323 - RNA, 1582 nt, Artificial Sequence
  KU312312.1 solE mRNA Design 3 opt
gggagaaagcuuaccaugucacaaaaaguaauauauuuaguaaugauacuacucauagcaccagcuuauaguauaagaugcauuggaguaucaaaucgagauuuuguagaagguaugucaggaggaacauggguagauguaguacuagaacaugguggauguguaacuguaauggcacaagacaaaccaacaguagacauagaauugguaacaacaacaguaaguaauauggcagaaguaagaucauauuguuaugaagcaagcauaucagauauggcaagugacagcagguguccaacucaaggugaagcauaccuagauaaacaaucagauacacaauauguuuguaaaagaacauuagucgacagagguuggggaaaugguugcggacuauucggaaaaggaagcuuaguaacaugugcaaaauuugcauguagcaaaaaaaugacagguaaaucaauucaaccagaaaauuuagaauacagaauaaugcuuaguguacacgguucccaacauaguggaaugaucguaaaugacaccggacaugaaacugaugaaaaucgugcaaaaguagaaauaacaccaaauuccccaagagcugaagcaacacuaggaggauucgguucauuaggauuagauugugaaccuagaacaggauuagauuuuucagaucuauauuaucuaacgaugaauaauaaacauugguuaguacauaaagaaugguuucaugauauaccauuacccuggcaugcuggagcagauacagggacaccacauuggaauaauaaagaagcguuaguugaauuuaaagacgcacaugcaaaaagacaaacaguaguaguacuuggaucacaagaaggcgcaguacauacagcacuagcaggagcacuggaagcugaaauggauggugcaaaggguagacuaucaagcggacaucuaaaauguagacuaaaaauggauaaacuaagacuaaaaggaguuuccuauaguuuguguacagcagcauuuacuuuuacaaaaauaccagcagaaacauuacauggaacaguaacaguagaaguucaauaugcaggaacggauggaccauguaaaguaccagcacaaauggcaguagacaugcaaacauuaacaccaguaggaagauuaauaaccgcuaauccaguaauaacagaaucaacagaaaauucaaaaaugaugcuugaacuugauccaccauuuggagauucauacauaguaauaggaguaggagaaaaaaaaauaacacaucacuggcacagaaguggaucaacaauaggaaaagcauuugaagcaacgguaagaggagcaaaaagaauggcaguauuaggagauacugccugggauuuuggaagcugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9324 - RNA, 1570 nt, Artificial Sequence
  AY632535.2 solE mRNA Design 3 opt
gggagaaagcuuaccaugucucaaaaaguaauauauuuaguuaugauauuauuaauagcaccagcauauucaauaagauguauaggaguaucaaauagagacuuuguagaaggaaugaguggaggaacauggguagauguaguacuagaacauggaggauguguaacaguuauggcacaagauaaaccaacgguagacauagaauuaguaacaacuacaguaucaaauauggcagaaguaagaagcuacuguuaugaagcaucaauuagugacauggcaagugacagcagauguccaacacaaggagaagcauauuuagauaaacaaagugauacacaauacguaugcaaaagaacauuaguagacagaggauggggaaauggauguggauuguuuggcaaaggaaguuuaguaacaugugcgaaauuuacuuguaguaagaaaaugacagggaaaucaauacaaccagaaaauuuagaauauagaauaaugcuaaguguacaugguucacaacacucagggaugauugguuacgaaacggaugaagauagagcaaaaguagaaguuacaccaaauagccccagagcagaagcaacguuagguggcuuuggcaguuuaggauuagauugugaaccaagaacaggauuagacuuuagugaucuauauuauuuaacaaugaauaauaaacauugguuaguacacaaagaaugguuccaugauauaccucuaccauggcaugcaggagcagauacaggcacaccgcacuggaauaauaaagaagcauuaguagaauuuaaagaugcacaugcaaaacgacaaaccguagucguauuaggaagucaagaaggggcaguucacacagcauuagcaggagcucuugaagcagaaauggauggagcaaaaggaagauuauucucaggacacuuaaaauguagacuaaaaauggauaaauugagacucaaagguguaucauauagucuguguacagcagcauucacauuuacaaaaguaccugcagaaacauuacaugggacaguaacaguugaaguacaauaugcagguacugauggaccauguaaaaucccuguacaaauggcaguggauaugcaaacucuaacaccaguaggaagacuaauaacagcuaauccaguaauaacagaaagcacagaaaauagcaaaaugauguuagaauuagauccacccuucggagauaguuacauaguaauaggaguuggagauaagaaaauaacacaccacuggcauagaucaggcaguacaauaggaaaagcauuugaagcuacagugagaggugcuaaacgaauggcuguauuaggagauacagcuugggauuuuggaaguugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9325 - RNA, 1582 nt, Artificial Sequence
  KU527068.1 solE mRNA Design 3 opt
gggagaaagcuuaccaugagccaaaaaguuauauaucuaguuaugauacuauuaauagccccagcauauaguauaagguguauaggggugaguaacagagauuucguagaaggaaugucaggaggaacauggguagauguaguacuagaacacggaggauguguuacaguaauggcacaagauaaaccaacaguagauauagagcuaguaacgacaacaguaaguaauauggcagaaguucgaucuuauuguuaugaagcaaguauaagugauauggcaagugauucacguuguccaacacaaggagaagcauauuuagauaaacaaagugauacucaauauguuugcaaaagaacauuaguagauagaggauggggaaacgggugugguuuauuugguaaaggaaguuuaguaacaugcgcaaaauuugcauguagcaagaaaaugacuggaaaaaguauacaaccagaaaauuuagaauauagaauaaugcuaagcguacacgguagucaacauagugguaugauugucaaugauacuggacaugaaacagacgaaaauagagcuaaaguagaaauaacaccaaauagcccacgagcagaagcuacacucggaggauuugguucuuuaggauuggauugugaaccucgaaccggacuagauuuuagcgaucucuacuacuuaacaaugaauaauaaacauuggcuaguacauaaagaaugguuucaugauaucccauuaccauggcaugcaggagcagauacaggaacaccacauuggaacaauaaagaagcauugguagaauuuaaagacgcacaugcaaaaagacaaacuguaguaguacuaggaucacaagagggugcuguacauacagcgcuagcaggcgcacuagaagcagaaauggauggugcaaaagggcgauuaaguucaggacaucuaaaauguagauuaaaaauggauaaauuaagacuaaaaggaguaucauauucauuauguacugcugcauuuacauuuacaaaaauaccggcagaaacauuacauggaacaguaacaguagaaguacaauaugcaggaacagacggaccauguaaagucccagcacaaauggcaguugauaugcaaacauuaacaccuguaggaagauuaauaacagcaaauccaguaauaacagaaucaacagaaaacucaaaaaugauguuagaauuagauccuccauuuggugacagcuauauaguaauagguguaggagaaaagaaaauuacacaccauuggcauagaagcggaucaaccauaggaaaagcauuugaggcaacaguaagaggagcaaaaagaauggcaguauugggagacacagcaugggauuucggaaguugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9326 - RNA, 1582 nt, Artificial Sequence
  KX421193.1 solE mRNA Design 3 opt
gggagaaagcuuaccaugagccaaaaaguaauauauuuaguaaugauauuacuuauagcuccagcuuauaguauaagauguauaggggucucaaauagagacuuuguugaaggaaugaguggaggaacauggguagacguaguuuuagaacauggaggauguguaacuguaauggcacaagauaaaccgacaguagauauagaauuaguaacaacaaccguaaguaauauggcagaaguaagaagcuauugcuaugaagcaagcaucagugauauggcaagugauaguagauguccaacacaaggagaagcauaccuagacaaacaaagugacacacaauauguauguaaaagaacacuaguagauagaggauggggaaacggaugcggauuauuugguaaagguucauuaguaacaugugcaaaauuuacauguagcaaaaaaaugacaggaaaaagcauucaaccagaaaaucuagaauacagaaucaugcuaucuguacauggaucacaacacagugguaugauaguuaaugauacuggauaugaaacagaugaaaauagggcaaaaguggaaguaacuccaaauagcccaagagcagaagcuacauuaggaggauucggaaguuuaggacuagauugcgaaccaagaacaggacuagacuuuucagaucuauauuauuuaacuaugaauaauaaacauugguuaguacacaaagaaugguuucaugauauaccauuaccauggcacgcaggagcagauacuggaacaccccauuggaauaauaaagaagcacuaguagaauucaaagaugcucaugcaaaaagacaaacuguaguaguauuaggcucacaagaaggagccgugcauaccgcauuagcuggagcucuagaagcugaaauggauggagcaaaagggaaauuauucaguggacacuuaaaaugucgacuaaaaauggauaaguugaggcuaaaagguguaaguuauucauuauguacagcagcauucacauuuacuaaaguaccagcagaaacauugcauggaacgguaacaguggaaguccaauaugcaggaacggauggaccaugcaaaauaccaguacagauggcaguagauaugcagacauuaacaccaguaggaagacuaauaacagcgaauccaguaauaacagaaaguacagaaaauaguaaaaugauguuggaauuagauccccccuuuggagauucauacauaguaauaggaguaggagauaaaaaaauaacucaccauuggcauaggaguggaucaacaaucggaaaagcauuugaagcaacuguaagaggagcaaaaaggauggcaguacuaggagauacagcaugggauuuuggaucaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9327 - RNA, 1582 nt, Artificial Sequence
  LC002520.1 solE mRNA Design 3 opt
gggagaaagcuuaccaugagucaaaaagucauauauuuaguaaugauauuauuaauugcaccugcauauaguauaagauguauaggaguaaguaauagagacuuuguagaaggaaugagugguggaacauggguagacguagucuuagaacauggaggauguguaacuguaauggcacaagacaaaccaacaguugauauagaauuaguuaccacaacaguaaguaauauggcagaaguaaggaguuauuguuaugaagcaaguaucagugacauggcaagugauagucgauguccaacacaaggagaagcauaucuagauaaacaaucagauacacaauauguauguaaaagaacauuaguagauagaggaugggguaacgguuguggacuauuugguaaaggaagcuuaguaacuugugcaaaauucacauguucaaaaaaaaugacaggaaaaucaauacaaccagaaaaucuggaauacagaauaauguuaucaguacauggaagucaacauaguggaaugacaguaaacgauauaggauaugaaacagaugaaaauagagcaaaaguagaaguaacuccaaauagcccaagggcagaagcaacacuaggagguuuuggaucacugggauuagauugcgaaccaagaacuggacucgacuucagcgauuuauacuauuuaacuaugaauaauaaacauugguuaguucauaaagaaugguuucacgacaucccauuaccauggcacgcaggagcggauacagguacaccacacuggaacaauaaagaggccuuaguagaauuuaaagaugcacaugcaaaaaggcaaacuguaguaguauugggaagucaagagggagcaguacauacagcacuagcaggugcauuagaagcagaaauggacggagcaaaagguaaacuauuuucaggacaucuaaaaugcagauuaaaaauggacaaauuacguuuaaaaggaguaaguuacucacuuuguacagcggcuuuuacauucacaaaaguaccagcagaaacauuacauggcacaguuacaguagaaguacaauaugcaggaacagacggaccauguaaaauaccaguacaaauggcaguagacaugcaaacacuaaccccgguaggaagacuuauaacagcaaauccaguaauaacagaaaguacugaaaauucaaaaaugaugcuagaauuagauccuccauuuggagauucauacauaguaauagguguaggggauaaaaaaauuacacaccauuggcauagauccggaagcacaauaggaaaagcauuugaagcaacgguaagaggagcuaaaagaauggcuguacuaggagauacagccugggauuuuggaucaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9328 - RNA, 1564 nt, Artificial Sequence
  DQ859059.1 solE mRNA Design 3 opt
gggagaaagcuuaccaugucgcaaaaaguuauauaucuaguaaugauauuauuaauagcaccagcuuauaguauaagauguauaggaguaucaaacagagauuuuguagaaggaaugagcggagggacauggguagacguaguauuagaacauggagguuguguaacaguaauggcacaagauaaaccaacggucgauauagaauugguaacgaccacgguaucaaauauggcagaaguaagaaguuauuguuaugaagcauccauaagcgauauggcaagcgauaguagauguccaacacaaggagaagcauaucuugauaaacaaucagauacccaauauguauguaaaagaacauuaguagauagaggauggggaaaugguuguggauuguucggaaaaggauccuuaguaacaugcgcaaaauuuacauguagcaaaaaaaugacuggaaaaaguauacaaccugaaaaucuagaauauagaauaauguuaucuguacauggaagucaacauucaggaaugauuguaaaugacgaaaauagagccaaaguagaagugacaccaaauagcccaagagcagaagcaacauuaggagguuuugguagcuuaggauuagacugugaaccacgaacagggcuggacuuuucagacuuauauuaucuaacuaugaauaauaaacauuggcucguacauaaagaaugguuucacgauauaccacuaccauggcaugcaggagcagauacaggcacaccacauuggaauaauaaagaagcauuaguagaauucaaagacgcacacgcaaaaagacaaacaguaguaguacuaggaucacaagaaggagcaguacauacagcuuuagcaggagcucuagaagcagaaauggauggagcaaaagguagacuauucagcggacauuuaaaauguagauuaaaaauggauaaacuaagguuaaaaggaguaaguuauaguuuauguacagcagcauuuacauuuacgaaaguaccagcagaaacauugcacggaacagugacaguugaaguacaauaugcgggaacagacggaccaugcaaaguaccagcacagauggccguagauaugcaaacauuaacaccaguaggucgacuaauaacugcaaauccaguuauuacagaaucuacagaaaauagcaaaaugaugcuagaguuagauccuccauucggagacaguuauauaguaauaggaguuggagauaaaaaaauaacacaucauuggcauagaaguggaaguacaauaggaaaagcauuugaagcaacaguaagaggagcuaaaagaauggcuguuuuaggagauacagcaugggacuuuggaaguugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9329 - RNA, 1570 nt, Artificial Sequence
  KU963573.2 solE mRNA Design 3 opt
gggagaaagcuuaccaugucacaaaaaguaauauacuuaguuaugauacuauuaauagcaccugcuuacagcauacgaugcauugguguaagcaaucgugacuuuguagagggaaugagcgguggaacauggguagacguaguauuagaacacggaggauguguaacaguaauggcgcaagauaaaccaaccguagauauagaauuaguuacaacaacaguaucaaauauggcagaaguaagaucauauuguuaugaagcaagcauaucagauauggcaagugacagucgaugcccaacacaaggagaagcauauuuagauaaacaaagcgauacacaauacguauguaaaagaacauuaguagauaggggauggggcaacgguugcggauuauucggcaaaggaagccuaguuacaugugccaaauuuacauguaguaaaaaaaugacuggaaaaucaauacaaccugaaaauuuagaauauagaauuaugcuaaguguacacggaagccaacacucaggaaugauuggauacgaaacagaugaaaacagggcuaaaguagaagucacaccaaauucaccaagagcagaagcaacacuuggaggcuucgguucgcuaggacucgauugugaaccaagaacaggacuagacuuuucugacuuauauuaucuaacaaugaauaauaaacauuggcuaguacauaaagaaugguuccacgauauaccauugccauggcacgcaggugcagauacaggaacaccacauuggaauaacaaagaagcauuaguagaauuuaaagacgcccaugcuaaaagacaaacaguaguaguacuaggaagucaagagggugcaguccauacagcauuagcaggagcacuagaagcagaaauggauggggcuaaagguaaauuauuuaguggacauuuaaaauguagauuaaaaauggacaaauuaagauuaaaaggaguaaguuacagcuuauguacagcagccuucacauuuacaaaaguaccagcagaaacauuacauggaacaguuacaguagaaguacaauaugcaggaacagauggaccauguaaaauaccaguccaaauggcaguagauaugcaaacauuaacaccaguaggaagauuaauaacagcaaauccuguaauaacagaaaguacagaaaauagcaaaaugauguuagaacuagauccaccauuuggugacaguuauauagugauaggaguuggagacaaaaaaauaacacaucauuggcaucgaucaggaaguacaauuggaaaagcauucgaagcaacuguaagaggagcaaaaagaauggcugucuuaggggacacagcaugggauuucggcaguugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9330 - RNA, 1582 nt, Artificial Sequence
  KY075939.1 solE mRNA Design 3 opt
gggagaaagcuuaccaugucucaaaaaguaauauauuuaguuaugauacuauugauagcucccgcauauagucuaagauguauaggaguaagcaauagagauuuuguagaaggaaugagcgguggaacauggguagauguaguauuagaacauggaggauguguaacaguuauggcacaagauaaaccaacaguagauauagaauuaguaacaacaacaguaucaaauauggcagaaguaagaucauauuguuaugaagcaaguauaagcgauauggcuucagauaguagaugcccaacccaaggagaagcauaccuagauaaacaaagugauacacaauacguauguaaaagaacguuaguagauagaggauggggaaauggaugcggauuauuuggaaaaggaagucuaguaacaugugcuaaauuugcauguucaaagaaaaugacaggaaaaucaauucaaccagaaaauuuagaauauagaauaauguuaagcguacaugguucacaacauaguggaaugaucguaaaugauacaggacaugaaacagaugaaaaucgagcuaaaguagaaauaacaccuaacaguccaagagcagaagcaacauuaggaggauuuggaaguuuaggauuggauugcgaaccaagaacagguuuagauuucucagauuuauauuaucuaacaaugaauaacaaacauugguugguacauaaagaaugguuucaugauauaccucuaccuuggcaugcaggagcagacacgggaacaccacacuggaauaauaaagaagcauuaguagaauuuaaagaugcucaugcaaaaagacaaacuguaguaguauuaggaagucaagaaggagcaguucauacagccuuagcaggagcauuagaagcagaaauggauggagcuaaaggaagauuaucaaguggacauuugaaaugcagauugaaaauggauaaauuaagauuaaaaggaguaucauauagucuauguacagcagcauuuacauuuacaaaaauaccagcggaaacacuacauggcacaguuacugucgaaguacaauaugcaggaacagacgguccauguaaaguaccagcacaaauggcagucgauaugcaaacauuaacaccagugggaagauuaauaacagcaaauccaguaauaacugaaucaacugaaaauucaaaaaugaugcuagaauuagauccacccuucggugauucguacauaguaauaggaguuggggaaaagaaaauaacacaucauuggcauagaucaggaaguacaauuggaaaagcauucgaagcuacuguuagaggcgcuaaaagaauggcaguauugggagauacagcaugggauuuuggaaguugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9331 - RNA, 1582 nt, Artificial Sequence
  KX447516.1 solE mRNA Design 3 opt
gggagaaagcuuaccaugagcaaaaaaguaauauaccuaguaaugauauuacuaauagcaccagcauacaguauacgauguauaggaguaaguaacagagauuuuguugaaggaaugucaggaggaacauggguugauguaguauuagaacacggcggauguguaacaguaauggcacaagauaaaccaacaguugauauagaauuaguaaccacaacaguuagcaauauggcugaaguaagaucauauuguuaugaagcaucaauaucagauauggcaagugauucaagauguccaacacaaggugaagcauaucuagacaaacaaucagauacacaauacguauguaaaagaacacuagucgauagaggauggggaaauggaugcgguuuauucggaaaagggucacuaguuacaugugccaaauuugcaugcagcaaaaaaaugacuggaaaaucaauucaaccagaaaaucuugaauauagaauaauguuaucaguacaugguucacaacauagcggaaugauuguuaacgacaccggacaugaaacagaugaaaaucgagcaaaaguagaaauaacuccaaacucaccaagagcugaagcaacauugggaggauucggaucauuaggacuagacugugaaccaagaaccggauuagauuuuucagacuuauauuauuuaacaaugaauaacaaacauugguuaguacacaaagaaugguuucacgacauaccacuaccauggcacgcaggagcugauacagguacaccacauuggaauaacaaagaagcucucguagaauuuaaagaugcacaugcaaaacgacaaacuguagucguauuaggaucucaagaaggagcuguacauacagcacuagcaggagcauuagaagcagaaauggauggagcuaaaggaagauuaagcucaggccaucucaaaugccgauuaaaaauggauaaauuaagauuaaaaggaguaucauauucauuauguacagcagcauucacauuuacaaaaauuccagcugaaacauuacaugguacuguaacaguagaaguacaauaugccgguacagaugguccauguaagguaccugcacaaauggcaguagauaugcaaacauuaacaccaguaggaagacuaauaacagcaaauccuguaauaacagaaaguacagaaaauucaaaaaugaugcuagaauuagacccaccguucggcgauaguuauauuguaauaggaguaggagaaaaaaaaauaacucaccauuggcauagaucaggcucaacaauaggaaaagcauuugaagcaacaguaagaggagcuaaaagaauggcuguucuaggagacacagcaugggauuuugguucaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9332 - RNA, 1582 nt, Artificial Sequence
  KX447515.1 solE mRNA Design 3 opt
gggagaaagcuuaccaugagccaaaaaguaaucuauuuagucaugauauuauugauagccccagcauacucuauaagauguauaggaguaaguaauagagacuucgucgaaggaaugaguggaggaacauggguagauguaguucuagaacauggaggauguguaacaguaauggcucaagacaaacccacaguagauauagaauuaguaacaacaacaguaagcaauauggcagaaguacgaaguuauugcuaugaagcaucaauaucagauauggcaucagauucaagauguccaacccaaggagaagcuuaucucgauaaacaaucagauacacaauauguauguaaaagaacucuaguagauaggggauggggaaaugguugcggucuauuuggaaaaggaaguuuagucacaugugcaaaauuugcaugcaguaaaaaaaugacaggaaaaucuauacaaccagagaacuuagaauauagaauaauguugaguguacacgguagucaacauagugguaugauagucaaugauacaggacaugaaacagaugaaaauagagcaaagguagaaauaacgccaaauucaccaagagcagaagcaacauuaggaggauuuggaagcuuaggacuagacugugaaccacgaacgggauuagauuuuagugaccuauauuauuuaacaaugaauaacaaacauuggcugguucauaaagaaugguuucacgauauaccacuaccauggcaugcuggagcagauacagguacaccacacuggaacaauaaagaagcauuaguagaauuuaaagacgcucaugcaaaaagacaaacgguaguagucuuaggaucacaagaaggagcaguacacacagcauuagcgggagcacuagaagcagaaauggauggugcaaaaggaagauuaaguaguggacaucuaaaauguagauuaaaaauggauaaauuaagguuaaaaggaguaaguuauucauuauguacggcggcauuuacauuuacaaaaauaccugcagaaacguuacauggaacaguuacagucgaaguucaauaugcuggaacagauggacccuguaaaguuccagcacaaauggcgguagauaugcaaacauuaacaccaguuggaagauuaaucacagcaaauccaguaauaacagaaaguacagaaaauaguaaaaugaugcuugaauuagauccaccauucggagauagcuauauaguaauuggaguaggugaaaaaaaaauaacgcaucauugguauagaucaggaucaacaauaggaaaagcauuugaagcaacuguaaggggagcaaaacguauggcaguauugggagauacagccugggacuuuggaaguugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9333 - RNA, 1582 nt, Artificial Sequence
  KU758874.1 solE mRNA Design 3 opt
gggagaaagcuuaccaugucacaaaaaguaauauaucuaguaaugauauuacuuauagcuccugcauauaguauacgaugcauaggggugucaaauagagauuuuguagaaggaaugagugggggaacauggguagauguaguacuagaacacggagguuguguaacagucauggcacaagauaaaccgacuguggauauagaacuuguaacaacuacaguaucaaauauggcagaaguaagaaguuauugcuacgaagcaaguauaagcgacauggcaagcgauuccagguguccaacacaaggagaagcauaccuagauaaacaaagcgauacucaauauguauguaaaagaacgcucguagauagaggcuggggaaauggauguggauuauuugguaaagggaguuuaguuacaugugcuaaauuugcaugcaguaagaaaaugacaggaaaaaguauacaaccagaaaauuuagaauaucgaauaauguugucaguucauggaagucaacauucaggaaugauaguaaaugauacaggacaugaaacagaugaaaauagagcgaaaguugaaauaacaccaaauucaccaagagcagaagcaacacuagggggauuugggucacuaggacuagauugugaaccaagaacaggauuagauuuuucagaucucuacuaccuaacaaugaacaauaaacacugguuaguacauaaagaaugguuucacgacaucccauuaccauggcaugcaggagcagauacaggaacgccacauuggaauaacaaagaagcauuaguagaauuuaaagaugcccaugcuaaaagacaaacaguuguaguacuugguucacaagaaggugcaguacacacagcauuagcaggagcauuagaagcagaaauggauggagcaaaaggaaaacuaagcucuggacaucuaaaaugcagacuaaaaauggauaaauuaagauuaaaaggaguaagcuauagucuaugcacagcagcauucacuuucacaaaaauaccagcagaaacauuacacggaacaguaacgguagaaguacaauaugcaggaacugacggaccauguaaagugccagcacaaauggcaguagauaugcagacauuaacaccaguagguagauuaauaacagcaaacccggugauuacugaaagcacugaaaauaguaaaaugauguuagaacuagauccaccuuuuggagauaguuauauaguuauaggaguaggagaaaagaaaauaacacaccacuggcacagaucaggaucaacaauaggaaaagcauuugaagcaacaguaagaggagcaaaaagaauggcuguacuaggagauacagcaugggacuuugguaguugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9334 - RNA, 1582 nt, Artificial Sequence
  KU729218.1 solE mRNA Design 3 opt
gggagaaagcuuaccaugucacaaaaaguaauauauuuaguaaugauacuccucaucgcaccagcauacucaauaagauguauaggaguaucaaacagagacuuuguagaaggaauguccggaggaacuuggguugauguuguauuagaacauggaggauguguaaccguaauggcacaagacaaaccaacaguagauauugaacuaguaacaacaacaguaucaaauauggcagaaguuagaaguuauuguuacgaagcaucaauaucagauauggcaucagauucaaggugcccaacacaaggagaagcauauuuagacaaacaaucagacacacaauauguaugcaaaagaacacuggucgauagaggauggggaaacggauguggauuguucggaaaaggaucauuaguuaccugugcaaaauucgcaugcagcaaaaaaaugacaggaaaaaguauacaaccagaaaauuuagaauacagaauaauguuaaguguucacggaucacaacauaguggaaugauuguuaacgacacaggacacgaaacagaugaaaauagagcaaaaguagaaauaacgccaaauucgccaagagcagaagcaacauuagguggauuuggaagcuuagguuuagauugugaaccaagaacaggacuugauuuuagcgauuuauacuaccuaacaaugaauaauaaacauugguuaguucacaaagaaugguuucaugauauaccauuaccauggcacgcaggagcagauacaggaacaccacacuggaauaacaaagaagcacuugucgaauuuaaagaugcgcacgcaaaaagacaaacaguaguuguucuaggaucacaagaaggagcaguacauacagcucuagcuggagcacuagaagcagaaauggacggagcaaaaggcagauuauccaguggacauuuaaaauguagacuaaaaauggacaaauuaagacuuaaaggaguuaguuauucacuauguacagccgcauucacauucacaaaaauuccagcagaaacacuacauggaacaguaacagucgaaguacaauaugcaggaacagauggaccauguaaaguaccggcacaaauggcuguagacacucagacauuaacaccaguaggaagguuaauuacagcaaauccaguaauaacugaaucaacagaaaauagcaaaaugauguuagaauuagauccaccauuuggugauaguuauauuguuauaggaguaggagaaaaaaaaauaacacaucauuggcaucgaucaggaagcacaauaggaaaagcauuugaagccacuguaagaggagcaaaaagaauggcaguacucggugauacagcgugggacuuuggaagcugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9335 - RNA, 1582 nt, Artificial Sequence
  KU501217.1 solE mRNA Design 3 opt
gggagaaagcuuaccaugucacaaaaaguaauauaccuaguaaugauauuauuaauagcuccagcauauaguauaagaugcauaggaguaaguaaucgagauuuuguagagggaaugagcggggguacauggguagacguaguauuggaacacggaggauguguaacaguaauggcacaagacaaaccaacaguagacauugaacugguuacgaccacuguaucaaauauggcagaaauaagaucauacugcuaugaagcgaguauaagugauauggcaucagauucuagauguccaacacaaggagaagcauaucuagacaaacaaagugauacacaguauguauguaaaagaacgcuaguagauagaggauggggaaauggauguggucuauuugggaaagguagcuuaguaacaugugcaaaauuugcaugcaguaaaaaaaugacaggaaaaucaauucaaccagaaaauuuagaauauagaauaauguuaucugugcauggaucacaacauucaggaaugauagugaacgauacaggacacgaaacugaugaaaauagagcaaaagucgaaauaaccccaaauucacccagagccgaagcaacauuaggaggauuuggaucacuaggccuugauugugaaccaagaacaggauuagacuuuucagacuuguauuaucuaacaaugaauaacaaacauugguuaguacauaaagaaugguuucaugauauaccauuaccuuggcaugcaggagcagauacggguacaccacauuggaauaauaaagaagcccucguagaauuuaaagaugcacaugcuaaaaggcaaacuguuguaguacuagguagucaagaaggagcuguacauacagcauuagcaggagcauuagaagcagaaauggacggggcaaaagguaggcucaguucaggacaccuaaaaugcagauuaaaaauggauaaauuaagacuaaaaggcguaaguuauaguuuauguacagcagcauuuacauucacaaaaauaccagcagaaacguuacauggaacaguaacaguagaaguacaauaugcaggaacagauggaccuugcaaaguuccagcacaaauggcaguagauaugcaaacacuaacaccaguaggaagacuaauaaccgcaaauccaguaauaacagagagcacagaaaauagcaaaaugaugcuagaauuagacccaccauucggagauuccuauauaguaauaggaguaggugaaaaaaaaauuacacaucacuggcaccgaucaggaucaacaauagguaaggcuuucgaagcaacaguaagaggagcuaaacguauggcaguauuaggagauacugcaugggauuuuggaucaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9336 - RNA, 1582 nt, Artificial Sequence
  KU761561.1 solE mRNA Design 3 opt
gggagaaagcuuaccaugucacaaaaaguaauauacuuaguuaugauuuuguuaauagcaccagcauauucaauaagaugcauuggaguaucaaauagagauuucguagaaggaaugagcggaggcacauggguagauguaguauuagaacaugguggauguguuacuguaauggcacaagauaaaccaacuguagacauagaacuaguaacaacaacaguaucaaauauggcagaaguaagaaguuauuguuaugaagcaagcauauccgauauggccucagacaguagauguccaacacaaggagaagcuuacuuagauaaacaaucagauacacaauauguauguaaaagaacacuaguagacagaggauggggaaauggaugcgguuuauucggaaaaggaagucuaguaacaugcgcaaaauuugcauguaguaaaaaaaugacaggaaaaaguauacaaccagaaaauuuagaauacagaauaaugcuaaguguccauggaagucaacauaguggaaugauuguaaaugacacaggacaugaaacagaugaaaauagagcgaaaguagaaauaacaccaaacucaccaagagcagaagcaacauuaggaggauuuggaucauuaggucuugauugugaaccaagaacuggacuugauuuuucagauuuauauuaccuaacaaugaauaauaaacacuggcugguacauaaagaaugguuccaugacauaccucuacccuggcacgcaggagcagauacagguaccccacauuggaauaauaaagaagcauuaguagaguucaaagaugcacaugcaaaaagacaaacaguaguuguauuaggaucacaagaaggagcaguacauacagcacuagcaggagcauuagaagcagaaauggacggcgcaaaaggcagacuuagcaguggacaccuaaaaugccgcuuaaaaauggauaaacuaagauuaaaaggaguaaguuauucauugugcacagcagcauucacauucacaaaaauacccgcagaaacacuacacgguacaguuacaguugaaguacaauaugcaggaacagauggaccauguaaaguuccagcacaaauggcaguagauaugcaaacauuaacaccaguaggucgauuaauaacagcaaacccaguaauuacagaaucaacagaaaauaguaaaaugauguuagaacucgaccccccauucggagacucauacauaguuauaggaguaggugaaaaaaaaauuacacaucacuggcacagaucaggaucaacaauaggaaaagcuuuugaagcaacaguuagaggagcacgaagaauggcuguauuaggagauaccgcgugggacuuuggaaguugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9337 - RNA, 1582 nt, Artificial Sequence
  KY075937.1 solE mRNA Design 3 opt
gggagaaagcuuaccaugucucaaaaaguuauauauuuaguaaugauuuuauuaauagcaccagcauauucaauuagauguauaggaguaucaaauagagauuuuguagagggaaugucuggaggaacauggguagauguaguucuagaacauggaggauguguaaccguaauggcgcaagauaaaccaacugucgauauagaauuaguaacaacaaccguuucaaauauggcagaaguaagaucauauuguuaugaagcaucaauaagugauaugguaagcgacucaagauguccaacacaaggagaagcauaucuggauaaacaaucggacacgcaauauguauguaaaaggacucuaguugauagaggauggggaaauggaugcgguuuauuugguaaaggaaguuuaguaacaugcgcaaaauuugcauguucaaaaaaaaugacaggaaaauccauacaaccugaaaauuuagaauacagaauaauguuaucaguacauggaagucaacauucaggaaugauaguaaacgacacaggacaugaaacagaugaaaacagagcuaaaguggaaauaacaccgaauagcccaagagcagaggcaacauuaggaggauuuggaucacugggauuagauugugaaccaagaacaggcuuagauuuuagcgacuuauacuauuuaacaaugaauaauaaacauuggcuagugcauaaagaaugguuccacgauauaccauuaccguggcaugcaggagcagauacaggaacaccacauuggaauaacaaagaagcuuuaguagaauuuaaagacgcccaugcaaaaagacaaacgguaguaguauugggaucacaagaaggugcaguacauacagcacuagcaggagcauuagaagcagaaauggauggcgcaaaaggaagacuaucgucaggacacuuaaaauguagauuaaagauggacaaacuuagauuaaaaggcguaaguuauucauugugcacagcagcauuuacauuuacaaaaauaccugcagaaacauuacauggaacaguaacuguagaaguacaauaugcaggaacagacgguccaugcaaaguaccagcacaaauggcaguagauaugcaaacacuaacaccaguaggaagacuaauaaccgcaaauccagucauaacagaaucaacagaaaauagcaaaaugaugcuagaauuagauccuccauucggagauagcuauauagucauagggguuggggaaaaaaaaauuacucaccacuggcauagaaguggaagcaccauaggaaaagcauuugaagcaacaguaagaggagccaaaagaauggcaguguuaggagauacggcaugggauuuuggaucaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9338 - RNA, 1582 nt, Artificial Sequence
  KY014317.1 solE mRNA Design 3 opt
gggagaaagcuuaccaugagucaaaaaguaauauaccuaguaaugauacuauuaauagcaccugcauauaguauaagauguauaggaguaucaaauagagauuucguagaaggaaugucaggaggcacauggguagacguaguuuuagaacauggaggauguguaacuguaauggcacaagauaaaccuacuguagauauagaauuaguaacaacaacaguaucaaacauggcagaaguaagaaguuauuguuaugaagcaagcauaucugauauggcaucagacucaagaugcccuacacaaggagaagcguacuuagacaaacaaagcgauacacaauauguauguaaaagaacacucguagauagaggaugggggaacggaugugguuuauucgggaaaggaucccuaguaacaugugcaaaauuugcauguaguaaaaaaaugacagggaaaucaauacaaccugaaaaccuagaauauagaauaauguuaagcguacauggaucacaacauucaggaaugauuguaaacgacacaggacaugaaacagaugaaaauagagcaaaaguagaaauuacaccaaauucaccaagggcugaagcaacauuaggagguuuuggaaguuuaggauuagauugugaaccaagaacaggacuagauuucagugauuuguacuacuuaacaaugaauaauaaacauuggcuuguucauaaagaaugguuccaugauauaccacuaccauggcacgcaggagcagauacuggaacaccucacuggaacaauaaagaagcacuaguugaauucaaagacgcccaugcaaaacgacaaacugucguaguauuaggaucacaagaaggagcaguacauacagcauuagcaggagcauuagaagccgaaauggauggagcuaaaggaagauuaucaucaggacaucuaaaguguaggcuaaaaauggacaaacuaagauuaaaaggagugaguuacaguuuauguacagccgcauuuacauuuacaaaaaucccagcagaaacacugcauggaacuguaacaguugaaguacaauaugcaggaacagaugggccaugcaaaguaccagcacaaauggcaguagauaugcaaacacuaacaccaguaggaagguuaauaacagcuaauccaguaauaacagaaaguauagaaaauaguaaaaugauguuagaacuagacccaccuuucggugauucuuauauaguaauaggaguaggugaaaaaaaaauaacacaucauuggcauagaucuggaaguaccauaggaaaagcauuugaagcuacaguaagaggagcuaaaagaauggcaguauuaggagauacagcaugggauuucgguaguugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9339 - RNA, 1582 nt, Artificial Sequence
  KU870645.1 solE mRNA Design 3 opt
gggagaaagcuuaccaugucacaaaaaguaauauaccuaguaaugauauuacuaauagcaccagcuuacucaauaagauguauagggguaucaaauagagauuuugucgaaggaaugucuggaggaacauggguagaugucguacuugaacacggaggauguguaacaguaauggcacaagauaaaccaacaguagauauagaauuaguuacaacaacaguaucaaacauggcugaaguaagaucauacuguuacgaagccucaauuucagauauggcaagugauucuagguguccaacgcaaggagaagccuauuuagauaaacaauccgauacacaauauguuuguaaaagaacuuuaguagauagaggaugggguaacggauguggauuauucggaaaagggucucuaguaacaugugcaaaauuugcauguaguaaaaaaaugacaggaaaaucaauacaaccugaaaaucuagaauacagaauaauguuaaguguacauggaagccaacauucaggaaugauaguaaaugauacaggacaugaaacagaugaaaaccgugccaaaguagaaauaacaccaaacucaccacgagcagaagcaacuuuaggaggauuugggucacuaggacuagacugugaaccaagaacuggacuugacuuuucugaucuauauuauuuaaccaugaauaacaaacacuggcuuguacacaaagaaugguuccaugauaucccauuaccauggcacgcaggagcagauacaggaacaccccauuggaauaauaaagaagcauuaguagaauuuaaagaugcacacgcaaaacgacaaacagucguuguauuaggaucacaagaaggagcaguacauacagcacuagcaggagcacuagaagcagaaauggauggagcaaaaggaagauuaucaagcggacaccuaaaauguagacuaaaaauggauaaauuaagauuaaaaggaguaaguuauaguuuauguacagcagcauucacauucacaaaaauaccagcagaaacacuacauggaacagucacaguagaaguacaauaugcuggaacagauggaccuuguaaaguaccagcacaaauggcaguagauaugcaaacauuaacuccaguaggaagauuaauuacagcaaauccuguaauaacagaaucaaccgaaaacucaaaaaugauguuagaauuagacccaccauuuggagacucauauauagucauaggaauaggcgaaaaaaaaauaacacaucacuggcacagaaguggcucaacaauaggaaaagcauuugaagcgacaguaaggggagcaaaaagaauggccguauuaggagacaccgcaugggacuuuggaagcugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9340 - RNA, 1582 nt, Artificial Sequence
  KU922923.1 solE mRNA Design 3 opt
gggagaaagcuuaccaugucgcaaaaaguaauauaucugguuaugauuuuguuaauagcauuagcauacucaauaagaugcauaggaguaaguaauagggauuuuguagaaggaaugaguggagguacauggguagauguaguauuagaacaugguggaugcguaacaguaauggcacaagauaaaccuacaguagacauagaauuaguaaccaccacaguuucaaacauggcagaagucagaucauacuguuacgaagcaagcauauccgauauggcaucagacucuagauguccaacccaaggugaagcauauuuagacaaacaaucagacacacaauauguauguaaacgaacuuuaguagauagaggauggggaaaugguugcggauuauuuggaaaaggaucauuaguaacaugugcaaaauucgcaugcaguaaaaaaaugacuggaaaaucaauacaacccgaaaauuuagaauauagaauaauguuaaguguucauggcagucaacauagugguaugauaguaaaugacacaggacaugaaacagaugaaaacagagcaaaaguugaaauaacaccaaacucuccaagagcagaagcaacauuaggagguuuugguaguuuaggacuagauugugaaccaagaacuggauuagauuuuucagaucuauauuauuugacaaugaauaauaaacauugguuaguucacaaagaaugguuccaugauauaccacuaccauggcaugcaggagcagauacaggaacaccacauuggaauaauaaagaagcauuaguggaauuuaaagaugcacaugcaaaacgacaaacaguaguuguacuaggaucacaagaaggagcaguacacacggcauuagcaggagcauuagaagcagaaauggauggggcaaaaggaagguuaagcuccgggcauuuaaaaugccgauuaaaaauggacaaauuaagauuaaaaggugugucuuauagucuauguacagcagcauuuacauuuacaaaaauaccggcagaaacacuucaugguacaguaacaguagaaguacaauaugcaggaacagauggcccauguaaagugccagcacaaauggcaguagacaugcaaacacuaacaccagucggaagauuaauaacugcaaauccaguaauaacagaaucaacagaaaacaguaaaaugauguuagaauuagacccuccguucggagacuccuauauaguaauaggaguaggugaaaaaaaaauaacacaucauuggcauagaucaggaucaacaauaggaaaagccuuugaagcaacaguaagaggagcaaaaagaauggcaguacuaggagacacagcaugggacuuuggauccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9341 - RNA, 1582 nt, Artificial Sequence
  KU497555.1 solE mRNA Design 3 opt
gggagaaagcuuaccaugucacaaaaaguaauuuacuuaguuaugauacuacuuauagcaccagcauauucaauaagauguauaggaguaucaaauagggacuuuguagaaggaaugaguggugguacuuggguagacguaguauuagaacacggaggauguguaacuguaauggcgcaagauaaaccaacaguagacauagaauuaguuacaaccaccguaaguaauauggcagaaguaagaaguuauugcuacgaagcaaguauaucagacauggcaagugauucaagauguccaacucaaggugaagcauauuuagauaaacaaucagauacacaauauguauguaaaagaacucuaguagacagaggaugggguaauggaugcggcuuauucggaaaaggauccuuaguuacaugugcuaaauuugcuuguaguaagaaaaugacaggaaaaaguauucaaccagaaaacuuagaauacagaauaauguugagcguacaugguagucagcauucaggaaugauagucaaugauacaggacaugaaacagaugaaaauagagcaaaaguagaaauaacaccaaauaguccaagagcagaagcgacauuaggaggauuuggaagccuaggacuagacugugaaccaagaaccgguuuagauuucuccgauuuauacuauuuaacaaugaacaacaaacacuggcuaguccauaaagaaugguuucaugauauuccacuaccauggcaugcaggagcagacacggguacaccacacuggaauaauaaagaagcauuaguagaauuuaaagaugcacaugcaaagagacagacaguaguuguauuaggaacacaagaaggugcaguacacacagcacuagcuggugcacuagaagcagaaauggauggagcaaaaggccgacuaaguaguggacaccuuaaauguagauuaaaaauggauaaauuaagauuaaaaggaguuucuuauaguuuauguacagcagcauucacauuuacaaaaauaccagcugaaacauuacacggaacaguaacaguugaaguucaauaugcaggaacagauggaccauguaaaguaccugcgcaaauggcuguagauaugcaaacguuaacaccaguaggaagauuaauaacugcaaacccaguuauaacagaaucuacagaaaauaguaaaaugauguuagaauuagacccuccauuuggcgauaguuauauaguaauaggaguaggagaaaagaaaauaacacaccacuggcauagaucaggaaguacaauaggaaaagcauuugaagcuacaguacgaggcgcuaaaaggauggcuguauuaggugauacagcaugggauuuuggaucaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9342 - RNA, 1582 nt, Artificial Sequence
  KU312314.1 solE mRNA Design 3 opt
gggagaaagcuuaccaugagccaaaaaguuauauauuuaguuaugauacuauuaauagcaccagcuuacaguauaagauguauaggaguaaguaauagagauuuuguagaggguaugucaggaggaacauggguagacguaguauuagaacauggaggauguguaacaguaauggcacaagauaaaccaacaguagauauagaacuaguaacgacaacaguaucaaauauggcugaaguuaggucauauuguuaugaagcaaguauuagugacauggcaucagauagcagauguccaacacaaggagaagcauaucuagacaaacaaagugauacacaauauguaugcaaaagaaccuuaguagauagaggauggggaaacggcuguggucuauuuggaaaaggaucauuaguaacaugcgcaaaauuugcaugcaguaaaaaaaugacaggaaaaucaauacaacccgaaaaucuagaauauagaauaauguuaaguguacauggaucacaacacucgggcaugauaguaaaugauacaggacaugaaacagaugaaaauagagcgaaaguagaaauaacaccaaauaguccuagagccgaagcaacguuaggaggauuuggcucacuuggacuggauugugaaccaagaaccggacuagauuuuucagauuuauauuauuuaacaaugaacaauaaacauugguuaguacacaaagaaugguuucaugauauccccuuaccauggcacgcaggugcagauacaggaacaccacauuggaauaauaaagaggcauuaguagaauuuaaagacgcacaugcaaaaagacaaacaguaguaguauuaggaagucaagaaggagcaguacauacagcauuagcuggagcccuagaagcggaaauggacggagcaaaaggaagguuaucaaguggacauuuaaaauguagacuaaaaauggauaaauuaagacuaaaaggaguaucauacagcuuguguacagcagcauuuacauuuacaaaaauaccagcagaaacauuacacgguacaguuacaguagaaguacaauaugcaggaacagacggaccuugcaaaguauuagcacaaauggccguagauaugcaaacacuaacaccaguaggaagauuaauaacagcaaauccaguaauaacagaaagcacagaaaacaguaaaaugauguuagaacucgauccacccuucggagauuccuacauagucauaggugugggagaaaaaaaaauuacacaucauuggcauagaagcggaagcacaauaggcaaagcauuugaagcaacagucagaggagcaaagcgaauggcaguucuaggagacacagccugggauuuuggaaguugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9343 - RNA, 1582 nt, Artificial Sequence
  KY014314.1 solE mRNA Design 3 opt
gggagaaagcuuaccaugagccaaaaaguaauauauuuaguaaugauauuacuaauagcaccagcauauaguauacgcuguauuggaguaucgaaucgagacuuuguagaaggaaugagcggaggaacauggguagauguaguacuagaacacggaggauguguuaccguuauggcacaggauaaaccaacaguagauauagaauuaguaacaacaacaguuaguaauauggcagaaguaagaagcuauuguuacgaagcaucaauaagcgacauggcaagcgauaguagaugcccaacacaaggagaagcauauuuagauaaacaaagugauacucaauauguaugcaaacgaacauuaguagacagaggauggggaaauggauguggauuauuuggaaaaggaagucuaguuacaugcgcaaaauuugcuuguagcaagaaaaugacaggaaaaucaauacaaccagaaaacuuggaauauagaauaauguuaucuguacauggaucacaacauucaggaaugauaguaaacgauacuggacacgaaacagaugaaaauagagcaaaaguugaaauuacacccaauagcccaagagcagaagcaacauuagggggauucggaucauuaggauuagacugugaaccaagaacaggauuagacuucucagauuuguauuauuuaacaaugaauaauaaacacuggcuaguacacaaagaaugguuucaugauauaccucucccauggcacgcaggagcugauacaggaacaccacacuggaauaacaaagaagcauuaguagaauuuaaagaagcacaugcaaaaagacaaacuguuguaguacuaggaagucaagaaggagcaguacacacugcauuagcaggagcuuuagaagcggaaauggauggagcaaaaggaagauuaucaaguggacaucuaaaauguagacuaaaaauggauaaacuaagauuaaaaggcguaaguuauagucuauguacggcugcguucacauucacaaaaauaccagcagaaacauuacacggaacaguaacaguagaaguacaauaugcaggcacagauggacccugcaaaguaccagcacaaauggcaguagauaugcaaacauuaacaccaguaggaagacuaauaacagcaaauccuguaauaacagaaaguaccgaaaauaguaaaaugauguuagaacuagauccaccauuuggagauaguuauauaguaaucggaguuggagaaaagaaaauaacucaucacuggcacagaagcgguaguaccauagguaaagcauuugaagcuacagugcgaggagcaaaaagaauggcaguuuuaggagauacagcaugggauuuuggaaguugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9344 - RNA, 1582 nt, Artificial Sequence
  KX447517.1 solE mRNA Design 3 opt
gggagaaagcuuaccaugucacaaaaaguaauauacuuaguuaugauauuacucaucgcuccggcauauaguauaagauguauuggaguaucaaauagagauuuuguagaaggaaugucaggaggaacauggguagaugugguauuagaacauggcggaugcguaacaguaauggcacaagauaaaccaacaguagacauagaauuagucaccacaacagucagcaauauggcagaaguaagaagcuauugcuaugaagcaucaauaagugauauggcaagugauagcagauguccaacacaaggagaagcuuaucuagauaaacaaagugauacacaauacguauguaaaagaacauuaguugacagaggauggggaaacggcuguggacuauuuggaaaaggaaguuuaguaacaugcgcaaaauucgcauguagcaaaaaaaugacaggaaaaaguauucaaccagaaaaccuagaauauagaauaauguuaagcguacauggaagucaacauucaggaaugauaguuaacgauacaggacaugaaacagaugaaaauagagcaaaaguagaaauaaccccaaauaguccuagagcagaagcagcauuaggaggauuuggaucacuaggauuagauugcgagccaagaacaggguuagauuuuucagauuuauauuaucuaacaaugaauaacaaacauugguuaguacacaaagaaugguuccacgauauaccauuaccauggcacgcaggcgcggacacaggaacaccccauuggaacaauaaagaagcauuaguagaauuuaaagaugcgcaugcaaaacgacaaacuguaguaguacuuggaagucaagaaggagcugugcauacagcucuggcaggagcuuuagaagcagaaauggauggagcaaaaggaagauuaucaaguggucacuuaaaauguagauuaaaaauggauaaacuaagguuaaaaggugugagcuacaguuuaugcacagcugcauuuacauuuaccaaaauaccugcagaaacacuacacggcacaguuacuguagaaguccaauaugcaggaacagacggaccauguaaagugccagcacaaauggcaguagacaugcaaacauuaacaccaguggggagacuaauaacagcaaauccaguaauaacagaaaguacagaaaauaguaaaaugauguuagaauuagauccaccauucggagauucauauauagucauaggugugggugaaaaaaaaauuacacaucauuggcauagaucaggaucaacgaucgguaaagcauuugaagcaacaguacguggggcgaaacgaauggcaguauuaggagauacggcaugggacuuuggaucaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9345 - RNA, 1582 nt, Artificial Sequence
  KU729217.2 solE mRNA Design 3 opt
gggagaaagcuuaccaugucacaaaaaguaauauaucuaguaaugauauuauuaauagcaccggcauauagcauaagauguaucggaguaaguaauagagacuuuguagaaggaaugaguggaggaacauggguugauguaguacuagaacauggaggaugcgugacaguaauggcucaagauaaaccaacaguagauauagaacuaguaagcacaacaguaaguaauauggcagaaguuagaagcuauuguuacgaagcaacaauaagugauauugcaagugacaguagauguccaacacaaggagaagcauaucuagauaaacaaagugauacacaauauguauguaaaagaacgcuuguagauagaggauggggaaauggcuguggacuauuuggaaaaggaagccuaguaacaugugcaaaauucgcaugcaguaaaaaaaugacaggaaaaaguauacagccagaaaauuuagaauacagaauaaugcuaaguguacauggaucacaacacaguggaaugauaguaaacgauacaggacaugaaacagaugaaaacagagcaaaaguagaaauaacaccgaauagcccgagggcugaagcaacauuaggaggauuuggaagcuuaggauuagauugugaaccaagaacaggauuagauuuuagugacuuauacuauuuaacaaugaauaauaaacacugguuaguacauaaagaaugguuccaugacauaccccuaccuuggcaugcaggugcagauacaggaacaccacauuggaauaauaaagaagcauuaguagaauuuaaagaugcucaugcuaaaagacaaacagcaguuguacuaggaucacaagaaggagcaguacauacagcacucgcaggggcauuagaagcagaaauggacggagcaaaaggcagauuaucaagcgggcauuuaaaauguagacuaaaaauggauaaauuaagacuaaaaggugugucauauucacuauguacagcugcauucacauuuacaaaaauaccagcagaaacauuacacggaacggucacagucgaaguccaauacgcaggaacagauggaccauguaaaguacccgcacagauggcaguagauaugcaaacacuuacaccaguagguagauuaauaacagcaaauccaguaauaacagaaaguacagaaaacaguaaaaugaugcuagaauuagauccaccauuuggagauucauauauaguaauuggagugggcgaaaaaaaaauuacacaucacuggcaucgaaguggaucaacaauaggaaaagcauuugaagcaaccguaaggggagcuaaaaggauggcagucuuaggagacacagcuugggauuucgguucaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9346 - RNA, 1582 nt, Artificial Sequence
  KY328290.1 solE mRNA Design 3 opt
gggagaaagcuuaccaugagucaaaaaguaauauaucuagugaugauauuauuaauagcaccagcauauagcauaagauguauaggagugucaaacagagauuucguagaaggaaugucaggaggaacauggguagaugugguacuagaacauggagguugcguuaccguaauggcacaagauaaaccaacaguagacauagaauuaguaacaaccaccguaaguaauauggcagaaguuagaaguuauuguuaugaagcaagcauaagcgacauggcaagcgacagcagauguccaacacaaggagaagcauauuuagauaaacaaagcgacacacaauauguaugcaaaagaacuuuaguagauagggguuggggaaauggcuguggacuauuuggaaaagguaguuuaguaacaugugcaaaauuugcauguucaaagaaaaugacuggaaaaucaauacaaccagaaaauuuagaauaucguauaaugcuaaguguacauggaucacaacacaguggaaugauaguaaaugauacaggacaugaaacagaugaaaauagagcaaaaguagaaauaacaccaaacucacccagagcugaagcaacguuaggaggauuuggaucauuaggauuagauugugaaccaaggacaggauuagauuuuagugaucuauauuaucuaacaaugaauaauaaacacugguuaguucauaaagaaugguuucaugauauaccauuaccauggcaugcaggagcagacacaggaacaccacauuggaacaauaaagaagcgcuaguggaauuuaaagaugcacacgcaaaaagacaaacuguaguuguacuaggaagucaagaaggggcaguacauacggcucuagcuggagcacuggaagcagaaauggacggggcuaaagguagauuaucgagcggacauuuaaaauguagguugaaaauggacaaacuuagauuaaaagguguaucauauaguuuauguacagcagcguuuacguuuaguaaaauaccugcagaaacauuacacggaacaguaacagaagaaguacaauacgcaggaacggauggucccugcaaaguuccagcacaaauggcuguggacaugcaaacauuaacaccuguaggaagauuaauaacagcaaacccaguaauaacagaaagcacagaaaauaguaaaaugauguuagaauuagauccaccauuuggagauaguuauaucguaauaggaguaggagaaaagaaaaucacucaucacuggcauagaagcgguaguacaauaggaaaagcauuugaagcaacaguaagaggagcaaaaagaauggcaguacuaggagauacagcgugggauuuuggaucaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9347 - RNA, 1582 nt, Artificial Sequence
  KX087101.3 solE mRNA Design 3 opt
gggagaaagcuuaccaugucacaaaaaguaauuuauuuaguuaugauauuacuaauagcaccagcauauucaauaagauguauaggagugaguaaucgagauuuuguagaaggcaugaguggaggaacuuggguagauguaguuuuagaacacggcggaugcguaacaguaauggcacaagauaaaccgacgguagacauagaauuaguaacaacaacaguuaguaacauggcagaaguaagaucauauuguuaugaagcaaguauaagugauauggcuagugauucaagauguccaacacaaggcgaagcauacuuagauaaacaaagcgauacacaauauguauguaagagaacauuaguagauagagguuggggaaauggauguggauuauuuggaaaaggaucacuaguaaccugcgcaaaauuugcuuguucaaaaaaaaugacaggaaaaucaauccaaccagaaaaucuagaauauagaauaauguuaucaguacaugggagccaacacucgggaaugauaguaaaugauacuggccacgaaacagacgaaaaucgagcaaaaguagaaauaacaccaaauucaccaagagcagaagcaacacuaggaggauuuggaucauuaggauuagacugugaaccaagaacuggacuagauuuuucagaccuauacuaucuaacaaugaauaauaaacacugguuaguacauaaagaaugguuucaugacauaccacugccauggcaugcaggcgcagauacgggaacgccacauuggaacaauaaagaagcauuaguugaauuuaaagaugcacaugcgaaaagacaaacuguaguaguauuaggaagccaagaaggagcaguucacaccgcauuagcuggagcguuagaagcagaaauggacggagcaaaagggagauuaucaagcggucaucuaaaaugcagacuaaaaauggauaaauuaagauuaaaaggaguaagcuauucgcuauguacagcagcauuuacauuuacaaaaauaccagcagaaacauuacauggaacaguaacaguagaauuacaauaugcuggcacagauggaccauguaaaguaccagcacaaauggcaguagauaugcaaacucuuacaccaguaggacgauuaauuacagcaaauccaguaauaacugaaucuacugaaaacaguaaaaugauguuagaauuagauccaccauuuggagauaguuauauaguaauaggaguaggagaaaaaaaaauaacacaucauuggcauagaucagguaguacaauaggaaaagcauuugaagcaacaguaagaggagcaaaaagaauggcaguuuuaggugauacagccugggauuuugguucgugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9348 - RNA, 1582 nt, Artificial Sequence
  KY003156.1 solE mRNA Design 3 opt
gggagaaagcuuaccaugagucaaaaagugaucuauuuaguaaugauucuacuaauagcaccagcauauucaauaagauguauaggcauaucuaacagggauuuuguugaaggaaugaguggaggaacuuggguagacguaguauuggaacauggaggauguguaacaguaauggcacaagauaaaccuacaguagacauagaacugguaacaacaacaguaaguaauauggcugaaguaaggucauacuguuacgaagcaaguauaagcgauauggcaagugauucaagaugcccaacacaaggagaagcauaucucgauaaacaaagcgauacacaauauguauguaaaagaacauuaguagauagaggauggggaaacgguugcggauuauuugggaaaggaucuuuaguaacaugugcaaaauucgcauguaguaaaaaaaugacaggaaaauccauacaaccagaaaacuuagaauauagaauaauguuaaguguacacgguagucaacauucaggaaugauuguaaaugauacaggacacgaaaccgacgaaaauagagcaaaaguagaaauaacaccaaacucaccaagagcagaagcaacacuaggaggauuuggaauacuuggauuagauugugaaccacgaacuggacuagauuuuucagaccuauauuaucuaacgaugaauaauaaacauuggcuaguacauaaagaaugguuucaugauauacccuuaccauggcaugcaggcgcagauacgggaacgccacauuggaacaacaaagaagcauuaguagaauuuaaagaugcacaugcaaaacgacaaacaguaguaguauuagggucacaagaaggagcaguacauacugcacuugcaggagcuuuagaagcagaaauggacggugcaaaaggaagauuaucaucaggacacuuaaaauguagauuaaaaauggacaaauuacgauuaaaaggaguaucauauagcuuaugcaccgcagcauuuacauuuacuaaaauaccugcugaaacauuacauggaaccguaacaguagaaguacaauaugcaggaacagauggaccauguaaaguaccagcacaaauggcaguagauaugcaaacacuaacaccaguaggaagacuuaucacagcaaauccaguaauaacagaaagcacggagaauucaaaaaugauguuagaacuagauccaccauuuggagacucauacauaguaauaggaguaggagaaaaaaaaauaacacaucauuggcacagaucaggaaguacuauaggaaaagcauuugaagcaacgguaagaggagcaaagagaauggcaguauuaggagauacagcaugggauuucggaucaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9349 - RNA, 1582 nt, Artificial Sequence
  KU758876.1 solE mRNA Design 3 opt
gggagaaagcuuaccaugucacaaaaaguaauauauuuaguaaugauauuauuaauagcaccagcauauaguauaagauguauaggaguaaguaauagagauuucguagaaggaaugagugggggaacauggguagauguaguauuagaacauggaggguguguaacaguaauggcacaagacaaaccaaccguggauauugaauuaguaacuacuacagucaguaauauggcagaagucagaucauauuguuacgaagcuaguauaucagacauggcgagugauagcagauguccaacacaaggagaagcauauuuagauaaacaaagugauacucaauauguauguaaaagaacauuaguugauagaggguggggaaauggauguggauuauuuggaaaaggaagcuuaguaacaugugcaaaauucgcauguaguaaaaaaaugacaggaaaaaguauacaaccagaaaacuuagaauauagaauaaugcugaguguacauggaucacaacauucaggaaugauaguaaaugauacaggacaugagacagaugaaaacagagcaaagguagaaauaacuccaaacaguccacgagcagaagcaacacuagguggauuuggaucacuaggacuagauugugaaccuagaacaggauuagauuuuucagauuuauauuaucuuacaaugaacaacaaacauuggcuaguacauaaagaaugguuccacgauauaccacuaccauggcaugcuggagccgauaccggcacuccacauuggaacaauaaagaagcauuaguagaauucaaagaugcacacgcuaaaagacagacagugguaguauuaggaagucaagaaggagcaguacacacagcacuagcaggagccuuagaagcagaaauggaugggguaaaagguagguuaagcaguggacacuuaaaauguagauuaaaaauggauaaacuaagacuuaaagguguaaguuacucauuauguacagcagcuuuuacguuuacuaaaaucccugcagaaacacuacauggaacaguaaccguggaaguacaauacgcaggaacagauggaccauguaaaguaccagcacaaauggcuguagauaugcaaacauuaaccccaguaggaagauugauaacagcaaauccaguaauaacagaaaguacagaaaauaguaaaaugauguuagaauuagauccucccuuuggugauagcuauauaguuauagguguaggagaaaaaaaaauaacacaucauuggcacagaucaggcagcacaauagguaaagcuuuugaagcaacaguaagaggagcaaaacgaauggcaguguugggagauacagccugggauuuuggaucaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9350 - RNA, 1582 nt, Artificial Sequence
  KU926310.1 solE mRNA Design 3 opt
gggagaaagcuuaccaugagccaaaaaguaauuuauuuaguaaugauacuauuaauagcaccagcauauaguauaagauguauagggguauccaacagagauuucguugaaggaaugagcggaggaacauggguagauguaguuuuagaacaugguggauguguaacaguaauggcacaagauaaaccuacaguagauauagaauuaguaacaacaacaguaucaaacauggcagaaguaagaaguuauugcuaugaagcaagcauuagugauauggcaagugauagucgauguccaacacaaggagaagcauaucuagacaaacaaagugacacacaauacguauguaaaagaacauuaguagauagaggaugggguaauggcugcggacuauucgggaaaggauccuuaguaacuugugcaaaauuugccuguaguaaaaaaaugacaggaaaaucaauacaacccgaaaaucuagaauaccgaauaaugcuaaguguacacggaagucaacauucaggaaugaucgugaaugacacagggcaugaaacugaugaaaacagagcaaaaguagaaauuacaccaaauucaccaagggcugaagcaacauuaggaggauucggaaguuuaggacuggauugugaacccagaacuggauuagacuuuucagauuuauacuauuuaacaaugaauaacaaacacuggcuaguacauaaagaaugguuucacgauauaccauuaccauggcaugcaggagcagauacaggaacaccacauuggaauaauaaagaagcacuaguagaauuuaaagaugcacacgcuaaaagacaaaccguuguaguauuaggaucacaagaaggagcgguucacacagcacuagccggagcauuagaagcggaaauggauggagcaaaaggaagauuaucaucaggucacuuaaaauguagguuaaaaauggauaaacuaagacuaaaaggaguaagcuauagucuuuguacagcagcauucacauucacaaaaauaccagcagaaacauuacauggaacaguaacaguugaaguacaauaugcaggagcagacggaccaugcaaaguaccugcacaaauggcaguggauaugcaaacauuaacuccaguagguagguuaauaacagcaaacccaguaauaacagaaaguacggaaaauucaaaaaugaugcuagaauuagauccaccauuuggagauaguuauauaguaauaggaguaggagaaaaaaaaauuacacaccauuggcauagaucagguaguacaauaggaaaagcauuugaagcaaccguacguggagcuaaaagaauggcuguauuaggagauacagcaugggacuuugguaguugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9351 - RNA, 1582 nt, Artificial Sequence
  KU681081.3 solE mRNA Design 3 opt
gggagaaagcuuaccaugucacaaaaaguaauauaucuaguuaugauacuauuaauagcaccagccuacaguauacgauguauuggaguaaguaauagagauuuuguugaaggaaugagugggggaacauggguagaugugguacuugaacauggaggaugugucacaguaauggcacaagauaaaccaacaguggauauagaauuaguaacaacuacaguaaguaacauggcagaaguaagaaguuauugcuacgaagcuucaauaagugacauggcaagugauagcagauguccgacacaaggcgaagcauaucuagauaaacaaagcgauacucaauauguauguaaaagaacauuaguagacagagguuggggcaauggauguggauuauuugguaaaggcucucuaguaacaugugcaaaauuugcauguucaaaaaaaaugacaggaaaaucaauucaaccagaaaaucuagaauauagaauaauguuaucaguccauggaagucaacauucagguaugauaguaaacgacacaggacaugaaacagaugaaaacagagcaaaaguagaaaucacaccaaauaguccaagagccgaagcaacuuuaggaggauucggaucauuaggauuagauugcgaaccaagaaccggguuagauuuuagugauuuauauuaucuuacuaugaauaauaaacauuggcuaguacauaaagaaugguuucaugauauaccauuaccuuggcacacuggagcagauacaggaacaccacauuggaacaauaaagaagcuuuaguagaauuuaaagaugcacaugcaaaaagacaaacaguaguaguauuaggaagucaagaaggagcuguacauacugcauuagcuggugcauuagaagcagaaauggauggagcaaaaggaaggcuaagcaguggacaucuaaaauguagauuaaaaauggauaaacuaagauuaaaaggaguaucauauagucuauguacagcagcauucacauuuacaaagauaccagcagaaacacuacacgguacaguaacgguagaaguccaauaugcaggaacagauggcccuuguaaagugccagcacaaauggcaguagauaugcaaacacuaacuccaguaggaagacuuauaacagcaaauccaguuauaacagaaggcacagaaaacaguaaaaugauguuagaacucgauccaccauuuggcgauucauauauaguaauaggaguaggagaaaaaaaaauaacacaucauuggcauaggucuggaucaacuauaggaaaagcauuugaggcaacuguaagaggagcaaaaagaauggcaguuuuaggugauacagcaugggauuuuggaucaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9352 - RNA, 1582 nt, Artificial Sequence
  KU744693.1 solE mRNA Design 3 opt
gggagaaagcuuaccaugucacaaaaaguaauauauuuaguaaugauauuguuaauagcaccagcguacaguauuagauguauaggaguuagcaauagagauuuuguagaaggaaugaguggaggaaccuggguagauguaguauuagaacaugggggauguguaacagcaauggcgcaagauaaaccaacaguagacauagaauuaguaacaacuaccguuaguaauauggcagaaguacgaagcuauuguuacgaagcuucaauaagugauauggcaagugacagcagauguccaacacaaggagaagcguaccuagauaaacaaagugauacacaauacguaugcaaaaggacuuuaguagauagaggauggggaaauggaugugguuuauuugggaaaggaagccuuguaacaugugcaaaauuugcauguagcaaaaaaaugacagguaaaucaauacaaccugaaaaucuagaauauagaauaauguuaagcguacauggaucacaacauagcggaauguuaguaaacgauacaggacaugaaacagaugaaaauagagcaaaaguagaaauaacgccaaacucaccucgagccgaagcaacauuagguggauuuggaucauuaggauuagauugcgaaccaagaacaggcuuagacuuuagcgauuuauauuacuuaacgaugaacaauaaacauugguuagcucauaaagaaugguuucaugauauaccacuaccauggcacgcgggagcagcaacaggaacgccucauuggaauaauaaagaagcauuaguagaauuuaaagaugcacaugcuaaaagacaaacaguaguaguacuaggaagccaagaaggagcaguacacacagcauuggcaggagcauuggaagcagaaauggauggagcaaaaggacgauuaaguucuggacauuuaaaaugucgauuaaaaauggauaaacuaagacucaaagggguaucauacucauuauguacagcagcguuuacauucacaaaaauaccagcagaaacaguagaugguacaguaacaguagaaggacaauaugguggaacagacggaccaugcaaagugccagcacaaauggcaguagauaugcaaacacuuacaccaguaggaagauuaauaacagcaaauccagugauaacagaaucgacagaaaacaguaaaaugauguuagaacuagauccaccuuuuggagauucauauauuguaauaggaguaggggaaaaaaaaauaacacaucauuggcauagaucuggaagcacgauaggaaaagcuuuugaagcaacaguaagaggagcaaaaagaauggcaguuuuaggggauacagcaugggauuucggaagcugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9353 - RNA, 1582 nt, Artificial Sequence
  EU545988.1 solE mRNA Design 3 opt
gggagaaagcuuaccaugagccaaaaaguuauauaccuaguaaugauauuauuaauagcaccagccuauaguauacgaugcauuggaguaucaaauagagauuucguagaaggcaugucagguggaacauggguagauguaguauuagaacauggaggauguguaacaguaauggcacaagacaaaccagcaguagauauagagcuaguaacaacuacaguaucaaauauggcagaaguaagaaguuacuguuaugaagcuagcauaagcgauauggcaucugauucuagguguccaacacaaggcgaagcauauuuagauaaacaaucugauacacaauacgucuguaaaagaacucuaguagauagaggauggggaaacggaugugguuuauucggaaaaggcagcuuaguuacaugugcaaaauuugcaugcucaaagaaaaugacaggaaaaucaauacaaccugaaaaccuagaauacagaauaauguuaucagugcacggaucacaacauagcggaaugauagucaaugauacaggacaugaaacagaugaaaacagagcuaaagucgaaauaacaccaaacaguccaagagcugaagcaacauuaggaggauucgguagcuuaggacuugauugcgaaccaagaacaggacuagauuuuucagaucuuuauuacuuaaccaugaacaacaaacauugguugguacacaaagaaugguuucaugauauaccacuaccuuggcaugcaggagcagauacuggaacaccacauuggaacaauaaagaagcauuaguagaauuuaaagacgcucaugcaaaaagacaaacagucguuguauuaggaucacaagaaggagcaguacauaccgcucuagcuggagcauuagaagcagaaauggauggagcaaaaggaagauuaucaucaggacacuuaaaaugcagacuaaaaauggacaaauuaagacucaaaggaguaucuuauucauuaugcaccgcagcauuuacauuuacaaaaauaccagcagaaacacuacauggaacuguaacagucgaaguccaauaugcaggaacagauggaccgugcaaagucccggcacaaauggcaguagacaugcaaacuuuaacaccaguaggacgauuaauaacugcaaauccuguaauaacagaaagcacagaaaauucaaaaaugaugcuagaauuagauccacccuucggagauucauauaucguaauaggaguaggagaaaagaaaauaacacaucauuggcauagaucaggaagcacuauagguaaagcauuugaagcaacaguaagaggugcaaaaagaauggccguuuuaggugauacagcaugggauuuuggcaguugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9354 - RNA, 1582 nt, Artificial Sequence
  KY007221.1 solE mRNA Design 3 opt
gggagaaagcuuaccaugagucaaaaaguaauauauuuagugaugauacuauuaauagcaccagcauauaguauaagauguauaggugugaauaauagagauuuuguugaaggaaugucagggggaacauggguagaugucgucuuagaacacggagguuguguaacagugauggcacaagauaaaccaacaguagauauagaauuaguaacaaccacaguaaguaauauggcagaaguaagaucauauuguuaugaggcaaguauaagugauauggcaagugauaguagauguccgacacagggagaagcauauuuagauaaacaaagcgauacucaauauguauguaaaagaacauuaguagauagaggauggggaaauggaugcggauuguuuggaaaaggaagucuagugacaugugcaaaauuugcaugcuccaaaaaaaugacaggaaaaucaauacaaccagagaacuuagaauauagaauaauguuaaguguacauggaagucaacacagcggaaugauaguuaaugauacaggacaugaaacagaugaaaaucgagcgaaaguugaaauaacuccaaacucaccuagagcagaagcaacauuaggaggguucggaucauuaggacuagauugugaaccaagaacaggacuagauuucagugacuuauauuaucuaacaaugaauaauaaacauuggcuaguacauaaagaaugguuucaugauauacccuuaccauggcaugcgggugcagauacagguacaccacauuggaauaauaaagaagcccuuguggaauuuaaagaugcacacgcaaaaagacaaacaguagucguacuagguucacaagaaggagccgugcacacagccuuagcaggagcacuggaagcagaaauggauggggcaaaaggaagauuaucgaguggacaucuaaaaugcagacuaaaaauggauaaauuaagauuaaaaggaguaaguuauucauuauguacagcagcauuuacauuuacaaaaauaccagcagaaacauuacauggaacaguaacaguugaaguacaauaugcgggaacagacggaccauguaaaguaccagcacaaauggcaguagacaugcaaaccuuaaccccagucggaagacuaauaacagcaaacccgguaauaaccgaaaguacagaaaacucuaaaaugauguuagaacuagauccaccauuuggagauaguuacauaguaauaggagugggagaaaagaaaauaacacaucacuggcauagaagcggaagcacaauuggcaaagcauucgaagcaaccguaagaggagcaaaaagaauggcaguauuaggagauacugcaugggauuuuggaucaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9355 - RNA, 1582 nt, Artificial Sequence
  KY003152.1 solE mRNA Design 3 opt
gggagaaagcuuaccaugucacaaaaaguaauauauuuagucaugauauugcuaauagcaccugcauauaguauaagauguauaggaguaaguaauagagacuuuguagaaggaaugagcggcggaacauggguagacguaguacuagaacauggaggauguguaacaguaauggcacaagauaaaccaacaguagauauagaauuaguaacaacaacaguaucuaacauggcugaaguaagaaguuauugcuacgaagcaaguauaagcgauauggcaucagauuccagauguccgacacaaggagaagcauauuuagauaaacaaagcgauacacaauaugugugcaaaagaacauuaguagauagaggauggggaaauggaugcggacuauuuggaaaagguagcuuaguaacaugugcaaaauuugcauguucuaaaaaaaugacaggaaaaagcauacaaccagaaaauuuagaauaucgaauaauguuaagcguacauggaucacagcauucaggaaugauaguaaacgauacaggucaugaaacagacgaaaauagagcaaaaguagaaauaacaccuaacuccccaagagcagaagcaacauuaggaggauuuggaucacuaggauuagauugugaaccaagaacuggacuugacuucagugacuuauauuauuuaacaaugaauaauaaacauugguuaguacauaaagaaugguuucacgacauaccauuaccauggcaugcaggagcagauacaggaacuccccauuggaauaauaaagaagcauuaguagaauuuaaagaugcacacgcaaaaagacaaacaguaguaguacuuggaagucaagaaggagcaguacauacagcuuuagcaggagcacuggaagcagaaauggacggugcuaaaggaagacuuucaaguggacaucuaaaaugucgguuaaaaauggauaaauuaagauuaaaaggcguaaguuauagcuuaugugcagcagcauuuacuuuuacaaaaauaccugcagaaacacuacacgguacaguuacgguagaaguccaauaugcuggaacggauggaccauguaaaguaccugcacaaauggcaguagauaugcagacauuaacuccagugggaagauuaaucacagcaaauccaguaauaacagaaaguacagaaaauaguaaaaugaugcuagaauuagauccaccauucggggauaguuauauaguaauaggaguaggugaaaaaaaaauaacacaucacuggcauagauccggaucgacaauaggaaaagcauuugaagcaacaguaagaggggcuaaaagaauggcaguauuaggagauacagcuugggauuuuggaucaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9356 - RNA, 1582 nt, Artificial Sequence
  KX694533.2 solE mRNA Design 3 opt
gggagaaagcuuaccaugucacaaaaaguaauauaccuaguaaugauauuauuaauagcaccagcauauagcauaagauguauaggaguaaguaauagagacuuugucgaaggaaugaguggaggaacauggguagacguaguauuagaacauggaggauguguaacaguuauggcacaagauaaaccaacaguagacauagaacuaguaacaacuacaguuucaaauauggcugaaguaagaaguuauuguuacgaagcaaguauuagcgauauggcgagugauucaagaugcccaacucaaggagaagcauaucuagauaaacaaagugauacacaauauguauguaaaagaacacuaguagacagaggauggggaaauggauguggauuauuuggaaaaggaucauuaguuacaugugcaaaauuugcauguucaaaaaaaaugacaggaaaaaguauacaaccugaaaauuuggaauauagaauaaugcugaguguacauggaucacaacacaguggaaugauagucaaugauauuggacaugaaacagaugaaaaucgagcaaaaguagaaauaacaccgaauagcccaagagcagaagcaacuuuaggaggauuuggaucauuagggcuagauugugaaccuagaacuggacuagauuuuagugacuuguauuacuuaacaaugaauaacaaacacuggcugguacauaaagaaugguuucaugauauaccauuaccauggcacgcaggugcagacacaggaacaccacauuggaauaauaaagaagcauuaguagaauucaaagaugcacaugcaaaaagacaaacagugguaguauuaggaagucaagaaggagcaguacauacugcauuagcaggugcuuuagaagcagaaauggauggagcaaaaggaagauuaucuucaggacauuuaaaaugcagauuaaaaauggacaaauuaagguuaaaaggaguaaguuacagccuuuguacagcagcauuuacuuuuacgaaaauccccgcagaaacuuuacauggaacaguaacaguagaaguacaauaugcaggaacagacggaccaugcaaaguaccagcacaaauggcagucgauaugcaaacauuaacaccuguaggaagacucauaacagcgaauccgguuauuacugaaucaacagaaaauaguaaaaugaugcuagaauuagacccaccauuuggagauucguauauaguaauaggaguaggcgauaaaaaaauaacacaucauuggcauagaucaggaucaacaauaggaaaagcauuugaagcaacaguaagaggagcaaaaagaauggcaguauuaggagauacagcaugggacuuuggaucgugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9357 - RNA, 1582 nt, Artificial Sequence
  KX601167.1 solE mRNA Design 3 opt
gggagaaagcuuaccaugucgcaaaaaguaauauauuuaguaaugauucuauuaauagcuccugcauauucaauaagauguauagguguaagcaauagagauuuuguagaaggaaugaguggaggaacguggguagauguaguauuagaacacggaggauguguaacuguaauggcacaagauaaaccaacuguagauauagaauuaguaacaacuacaguaucaaauauggccgaaguaagaagcuauugcuaugaagcuaguauaagugacauggcaucagacucaagauguccaacacaaggcgaagcauaccuagauaaacaaagugauacacaauaugucugcaaaaggacgcuaguagauagaggauggggaaauggauguggucuauuuggaaaagggucauuagucacaugugcaaaauuugcauguucaaagaaaaugacaggaaaaucaauacagccagaaaauuuagaauauagaauuauguuaaguguacacggaagccaacacucaggaaugauuguaaacgacacaggacaugaaaccgaugaaaacagagcaaaaguagaaauaacaccuaauucaccaagagcagaagcaacguuaggaggauuugguucuuuaggacuagauugugaaccaaggacaggacuagauuuuagugacuuauauuacuuaacaaugaacaauaaacauuggcuaguucauaaagaaugguuucaugauauaccucuaccauggcacgccggagcagauacuggaaccccacauuggaauaauaaagaagcauuaguagaauuuaaagaugcacacgcaaaaagacaaacuguaguaguauuagguucucaagaaggugcaguacacacagcuuuagcaggagcauuagaagcagaaauggauggugcaaaaggaagacuaaguaguggacacuuaaaauguagauuaaaaauggauaaacuaagauuaaaaggaguaucauauucauuauguacugcagcauucacauucacaaaaauuccagcagaaacuuuacauggaacaguuacaguugaaguacaauaugcaggaacagauggaccaugcaaaguaccagcgcaaauggcaguagauaugcaaacauuaacuccaguaggacgauuaauaaccgcaaauccaguaauaacagaaaguacagaaaacaguaaaaugaugcuugaauuagacccaccauuuggagauucauauauuguaauagguguaggagacaagaaaauaacacaccacugguacagaucgggaucaacgauaggaaaagcauuugaagcaacaguaagaggagcaaaaagaauggcaguauuaggagacacagcaugggauuuuggaucaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9358 - RNA, 1582 nt, Artificial Sequence
  KY288905.1 solE mRNA Design 3 opt
gggagaaagcuuaccaugucacaaaaagugauauauuuaguaaugauauuacuaauagcaccagcauacaguauaagauguauaggaguaucuaauagagauuuuguagaaggaaugucaggaggaacauggguagauguaguacuagaacacggaggauguguaacaguaauggcacaagacaaaccaacaguagauauagaauuaguaacaacaacuguaagcaacauggcagaaguuagaaguuauuguuaugaagcaaguauaagugauauggcaagugauucaagauguccuacacaaggagaagcauacuuagacaaacaaagcgauacacaauauguuugcaaaagaacguuagucgaccgaggaugggggaacggauguggacuauuuggaaaaggaagucuaguaacaugugcuaaauuuacauguagcaaaaaaaugacaggaaaaucaauacaaccagaaaauuuagaauacagaauaauguuaagugugcauggaucacaacauagcggaaugauaguuaaugauacugggcacgaaacugaugaaaauagagcgaaaguagaagucacaccaaacaguccaagagcggaagcaacuuuaggaggauucgguucauuaggacuagauugcgaaccuaggacuggauuagauuuuucagaucuauauuaucuuacaaugaauaauaaacauugguuaguacauaaagaaugguuucaugauauaccacuaccguggcaugcaggagcagauacaggaacaccucauuggaauaacaaagaagcauuaguagaauucaaagaugcacaugcaaaacgacaaacgguaguaguacuuggaagucaagaaggagcaguacacacagcauuagcaggagcuuuagaagccgagauggacggggcaaaaggcagacuauuuagcggacacuuaaaaugcagauuaaaaauggauaaauuaagauuaaagggaguaaguuauucauuauguacagcugcauuuacuuuuacaaaaguuccagcagagacauuacauggaacaguaacaguggaaguacaauaugcaggaacagaugggccauguaaaguuccagcacaaauggcaguagauaugcaaacauuaacuccaguaggaagacuuauuacagcaaauccaguaauaacagaaaguacagaaaauaguaaaaugaugcuugaauuagacccaccauuuggggauucuuauauagucauaggaguuggagauaaaaaaauaacucaucauuggcauagaucuggcucaacuauaggaaaagcguuugaagcaacgguaagaggagcaaaaagaauggcuguacuaggcgacacagcuugggauuuuggaucaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9359 - RNA, 1582 nt, Artificial Sequence
  KF268950.1 solE mRNA Design 3 opt
gggagaaagcuuaccaugucacaaaaaguuauauauuuaguaaugauauuguuaauagcaccggcauauaguauaagauguauaggaguaucaaauagagauuuugucgaaggaaugaguggaggaacauggguugauguaguauuagaacauggcggaugcguaacuguaauggcacaagauaaaccaacuguggauauagaauuaguaacaacaacaguaagcaauauggcagaaguaagaaguuauuguuaugaagcaucaauaagugauauggcaagugauucucgaugcccgacacaaggagaagcauacuuagauaaacaaagugauacacaauauguaugcaagcgaacacuuguagacagaggauggggaaacggaugugguuuauucgguaaaggaaguuuaguaacuugugcaaaauuuacauguagcaaaaaaaugacaggaaaaucaauacaaccugagaauuuagaauauagaauuaugcuaagcguacacgggucacaacauagcggaaugauaguaaaugauauaggacaugaaacagaugaaaauagagcaaaaguagaaguaacuccaaauaguccaagagcagaagcaacauuagggggcuucgguucauuagguuuagacugcgaaccacggacuggacuagacuucucagauuuauauuauuuaacaaugaauaacaaacacuggcugguacauaaagaaugguuucacgauauaccuuuaccauggcaugcgggcgcagauacaggaacaccucauuggaauaacaaagaagcacuaguagaauuuaaagaugcacaugcaaaacgacaaacaguaguaguauuaggaagucaagaaggggcaguacauacagcacuagcgggagcauuagaggcagaaauggauggagcaaaaggaagguuauucagcggacauuuaaaauguagacuuaaaauggauaaauuaagauuaaaaggaguaagcuauaguuuauguacagcagcauuuacauuuacaaaaguaccagcagaaacauuacauggcacaguaaccguagaaguacaauaugcaggaacagauggaccaugcaaaguaccagcucaaauggcuguagauaugcaaacacuaacaccuguaggaagacugauuacagcuaauccagucauaacagaaaguacggaaaauagcaaaaugauguuagaacuagauccaccauuuggggauagcuacauaguaauaggaguaggagauaaaaaaauaacacaucacuggcauagaucaggaucaacaauaggaaaagcauuugaagcaacaguaagaggagcaaaacgcauggcaguauuaggggacacagcuugggauuuuggaucaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9360 - RNA, 1582 nt, Artificial Sequence
  KF383116.1 solE mRNA Design 3 opt
gggagaaagcuuaccaugagucaaaaaguuauauauuuaguuaugauauuacuaauagcaccagcauauucaauaagauguauaggaguaagcaacagagauuuuguugaaggaaugagcgguggaacauggguagacguaguauuagaacauggaggauguguaacaguaauggcacaagauaaaccaacaguagacauagaacuaguaacaacaacaguuucaaauauggcagaaguaagaaguuauugcuaugaagcaaguauaagugacauggcaagugauaguagauguccaacucaaggugaagcauacuuagauaaacagagugacacacaauacguauguaaacgaacucuaguagacagaggcuggggaaauggaugugggcuuuucggaaaaggaucauuaguuacgugugcaaaauuuacaugcaguaaaaaaaugacaggaaaaucaauacaaccagaaaaucuggaauauagaauaauguuaagcguacauggaagucaacauucaggaaugauaguaaacgauaucggacaugaaacagaugaaaacagagcaaaaguagaaguaacuccaaauagcccaagagcagaagcaacauuaggaggauuuggaucauuaggucuagauugugaaccaagaacaggacuagauuuuagugaucuauacuaucuaacaaugaauaauaaacauugguuaguacacaaagaaugguuccaugauauaccauuacccuggcaugcaggagcagacacaggaacaccacauuggaacaauaaagaagcauuaguagaauuuaaagacgcacaugcaaaaagacaaacuguaguagugcuaggaagucaagaaggagcuguacacacagcacuagcaggugcauuagaggcagagauggauggagcaaaaggaagauuauuuaguggacaucuaaaguguagacuaaaaauggacaaauuaagauuaaaaggaguaaguuauagucugugcacagcuguaugcacagcagcaaaaguaccagcagaaacuuuacauggaacaguaacuguagaaguacaauaugcagggacagaugguccuuguaaaguaccagcucaaauggcaguagacaugcaaacgcuaacaccaguaggaagacuaaucacagcaaauccaguuauaaccgaaaguacagaaaauagcaaaaugauguuagaacucgauccuccauuuggagauagcuauaucguaauaggaguaggagacaaaaaaauaacucaucauuggcauagaaguggaucaacaauaggaaaagcauuugaagcaacaguaagaggugcaaaaagaauggcaguacuaggagacacagcaugggacuuuggaucaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9361 - RNA, 1564 nt, Artificial Sequence
  KU963574.2 solE mRNA Design 3 opt
gggagaaagcuuaccaugucacaaaaaguaauauacuuaguuaugauauuacuaauagcaccggcuuauaguauaagaugcauaggaguaagcaauagagauuuuguagaaggaaugagcggaggaacauggguagauguaguauuagaacacggaggcugcguaacaguaauggcucaagauaaaccaacuguagauauagaacuaguaacaacuacaguaucaaauauggcagagguaagaaguuauuguuaugaagcaucaauaagcgauauggcaucagacaguagauguccaacacaaggugaagcauauuuagauaaacaaagugauacacaauauguauguaaaagaacccuaguagacaggggauggggaaauggcuguggauuauuuggaaaaggaucacuaguuacaugugcaaaauucacauguagcaaaaaaaugacaggaaaaucaauacaaccagaaaacuuagaauacagaauaauguuaaguguacacggaagccaacauucagguaugauaguaaaugaugaaaacagagcaaaaguagaaguuacaccaaauucaccaagagcagaagcaacacuaggaggauuugguucucuuggauuagauugugagccaagaacaggucuggauuuuagugacuuauauuacuuaacaaugaauaauaaacauugguuaguucacaaagaaugguuccaugauauucccuuaccauggcauucaggagcagauacagaaacaccacauuggaauaauaaagaagcauuaguagaauuuaaagaugcacaugcaaaaagacaaacaguuguuguacugggaagccaagaaggggcaguacauacagcauuagcuggagcacuagaagccgaaauggauggagcgaaaggcagacuaucaaguggacauuuaaaauguagauuaaaaauggauaaauuaagauuaaaaggaguaagcuacucauuauguacagcagcauucacauuuacaaaaguaccagcagaaacauuacaugguacaguaacaguagaaguccaauaugcuggaagagauggaccauguaaaguaccagcacaaauggcaguagauaugcaaacauuaacaccaguugguagauuaauaacagcuaauccagugauaacugaaucaacagaaaauaguaagaugauguuagaacuagauccaccauucggagacaguuauauaguaauaggagucggagauaaaaaaauaacgcaucauuggcauagaagcggaaguauuauaggaaaagcauucgaagcaacaguaagaggagcaaaaagaauggcgguacuaggagauacagcuugggauuuugguaguugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9362 - RNA, 1582 nt, Artificial Sequence
  KF383118.1 solE mRNA Design 3 opt
gggagaaagcuuaccaugucgcaaaaaguaauauaucucguuaugauaguucuaauaguaccagcuuacaguauaagcuguauaggaguaucaaauagagacuuaguggaaggcaugagcggagguacauggguagacguaguauuagaacacggaggaugcguaacagaaauggcccaagauaaaccaacuguggauauagaauuaguaacgaugacaguaagcaauauggcugagguaagaagcuauuguuacgaagcaaguuuaucagauauggcuagcgcaucaagguguccaacacaaggcgaaccaucauuagauaaacaaagugauacucaaaguguauguaaaagaacucuaggagauaggggauggggaaauggaugcggaauauucgguaaaggaagucuaguaacaugcaguaaauucacauguuguaaaaaaaugccuggaaaaucaauucaaccagaaaauuuagaauacagaauaaugcuaccaguacauggaagucaacauagcggaaugauaguuaaugauauaggacaugaaacugaugaaaacagagcaaaaguagaaguaacuccaaacagcccuagagcagaagcaacacucggaggauucggaucacucggauuagauugugaaccaagaacaggacuugacuucagugaucuuuacuauuuaacgaugaauaacaaacauugguuaguacauaaagaaugguuccaugauauaccauuaccauggcaugcaggagcagauacaggaacaccacauuggaacaauaaagaagcguuaguagaauuuaaagaugcacaugcaaaaagacaaacaguaguaguauuaggaagccaagaaggagcuguacacacggcacuagcaggggcauuagaagcagaaauggauggagccaaagguagauuauuuaguggacauuuaaaauguagauuaaaaauggauaaacuaagacuaaaaggaguaaguuacagcuuauguacagcagcauuuacauucacaaagguaccagccgaaaccuuacacggaacaguuacaguagaaguccaaagugcaggcacagaugguccauguaaaguaccggcacaaauggcaguagauaugcaaacuuuaacaccuguaggaagguuaauaacagcaaauccaguaauaacagaaagcacagaaaauaguaaaaugaugcuagaauuagacccaccauuuggagauucauauauaguaauaggagucggagauaaaaaaauaacacaucauuggcacagaaguggaucaacaauaggaaaagcauuugaagcaacaguaagaggcgccaaaagaauggcaguauuaggagauacagcaugggauuuuggaucuugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9363 - RNA, 1582 nt, Artificial Sequence
  KX520666.1 solE mRNA Design 3 opt
gggagaaagcuuaccaugagacaaaaaguaauauauuuaguaaugauauuacuaauugcaccugcauauucaauaagaugcauagguguuaguaauagagauuuuguugaaggaaugucaggaggaacuuggguagacguaguacuagaacaugguggcuguguaacaguaauggcacaagauaaaccaacaguagauauagagcuaguuacgacaacaguuagcaacauggcagagguaagaaguuauuguuaugaagcaaguauaucagacauggcaagcgauucaagguguccaacacaaggugaagcauacuuagauaaacaaagugauacacaauacguauguaaaagaaccuuaguugauagagguuggggaaaugguuguggacuauuuggaaaaggaaguuuaguuacaugcgcaaaauuugcauguaguaaaaaaaugacaggaaaaucaauacaaccagagaauuuagaauauagaauaaugcuuaguguacauggaagucaacauagcggaaugauaguaaaugacacaggacaugaaacugaugaaaauagagcaaaaguagaaauaacaccaaauucacccagagcagaagcuacauuaggaggauuuggaucauuaggauuagacugugaaccuagaaccggauuagauuuuucagaucuauauuacuuaacaaugaauaauaaacauugguuaguacauaaagaaugguuucaugauauaccguuaccauggcaugcaggcgcagauacaggaaccccacacuggaauaauaaagaagcacuaguagaauuuaaagaugcccaugcaaaacgucaaacuguaguaguacuaggaucacaagaaggagcaguacacacugcauuagccggagcuuuagaagcagaaauggauggagcgaaaggaagacuaucaucuggacaccuaaaauguagauuaaaaauggauaaauuaagauuaaaaggaguaaguuauaguuuaugcacagcagcauucacauuuacgaaaauuccagcagaaacauuacacggaacaguaacaguagaaguucaauaugcgggaacagacggaccauguaaaguaccagcacaaauggcaguugauaugcagacauugacucccguuggaagacuaauaacagcaaauccaguaauaacugaaucaacagaaaacucaaaaaugaugcuagaauuagauccaccauuuggagauucauauauaguaauaggaguaggugaaaaaaaaauaacucaucauuggcacagaagugggaguacaauaggaaaagcauuugaagcaacuguaagaggggcaaaacgaauggcaguacuaggagauacugcaugggauuuuggaagcugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9364 - RNA, 1582 nt, Artificial Sequence
  KF383120.1 solE mRNA Design 3 opt
gggagaaagcuuaccaugagucaaagaguaauauacuuaguaaugauauuauugauagcaccagcauauucaauuagauguauaggaguaaguaauagagauuuuguagaaggaaugaguggaggaacauggguagauguaguauuagaacauggaggauguguaacuguuauggcacaagauaaaccaacaguagauauagaauuaguaacaacaacaguaucaaauauggcagaaguaagaagcuacuguuacgaagcaucaaucucugauauggcaagugauaguagauguccgacacaaggagaagcuuauuuagauaaacaaagcgauacacaauauguaugcaaaagaacauuaguugauagaggauggggaaauggauguggauuauuuggaaaagguagucuaguaacaugugcuaaauuuacauguagcaaaaaaaugacaggaaaaaguauacaaccagaaaaucuagaauauaggauaaugcuaucaguacacggaagucaacacagcggaaugauuguaaaugacauaggacacgaaacagaugaaaaucgagcaaaaguagaaguaacuccaaauucaccuagagcagaagcaaccuuaggagguuuugggucauuaggacuagacugugaaccaagaacaggauuagauuuuagugacuuauauuacuuaacaaugaauaauaaacauuggcuaguacacaaagaaugguuucacgauauaccacuaccauggcacgcaggagcagauacuggaacaccacauuggaauaauaaagaagcauugguugaauuuaaagaugcacaugcuaaaagacaaaccguaguaguguuaggcagccaagaaggagcaguacauacagcuuuagcaggagcauuagaagcagaaauggauggagcaaaagguagauuauuuucaggacaucugaaauguagaauaaaaauggauaaauuaagauuaaaaggaguauccuauaguuuauguacagcagcauucacguuuaguaaaguaccagcagaaacguuacaugguacaguaacaguagaaguacaauaugcagguagggacggaccguguaaaguaccagcacaaauggccguagauaugcaaacauuaacaccaguaggacgauuaauaacagcaaacccaauaauaacagaaucaacugaaaauaguagaaugauguuagaauuagauccaccauuuggagauucauauauaguuauagguguaggagauaaaaaaauaacccaucauuggcauagaaguggcucaacaauagguaaggcauuugaagcgacaguaagaggagcgaaaagaauggcugugcuaggagauacugcaugggauuuuggaagcugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9365 - RNA, 2365 nt, Artificial Sequence
  ZIKV (strain ZikaSPH2015) Polyprotein(93-804) mRNA Design 3 opt
gggagaaagcuuaccaugcguauaaucaacgcacgaaaagagaagaaaaggcgcggcgccgacacuucagucgguaucgucggccuccuccucacaaccgccauggccgcagaagucacccgccgaggaagugcauacuacauguaccuagaccgcaaugacgccggagaagcaaucagcuuccccaccacacucgguaugaacaaaugcuacauacaaauaauggaccucggucacaugugcgacgccacgaugagcuacgaaugccccaugcucgacgaaggggucgaaccagacgacguugacugcuggugcaacacaaccucuacuugggucgucuacgguaccugccaccacaagaaaggcgaagcgcgacgaucccgcagggccgucacccugccgagccauucaacccgaaaacuacaaacccgaagccaaaccuggcucgaaucucgcgaauacaccaaacacuugauccgcgucgaaaacuggauuuucagaaacccaggcuucgcacucgcggcagccgcaauagccuggcuccucggcucaucaacaucccagaaagucaucuaccucguaaugauucuacucaucgccccagcauacucaauacggugcauaggaguguccaaccgcgacuucgucgagggaaugucaggcggcacauggguagacauaguacucgaacacggaggaugcgucaccguaauggcccaagacaaaccaaccguugacauagaacucguaaccacaaccguaagcaacauggcagaaguccgcucauacugcuacgaggcauccaucagcgacauggccuccgacagccgaugccccacccaaggagaggccuaccucgauaaacaaagcgacacccaauacgucugcaaaagaacccucguagauagagguuggggcaacggcugcggucuauucggcaaaggaagccuaguaacaugcgccaaauucgccugcuccaagaaaaugaccggcaaauccauccaaccggagaaccuugaauauagaaucaugcuguccguacacggaucccaacacuccggaaugauagucaacgacacaggccacgagaccgacgagaaccgagcaaaaguagagaucacacccaacucgccaagagccgaagccacccuagguggcuucggaucacuuggccucgacugcgaaccccggacagggcucgacuucucagaccucuacuaccucaccaugaacaacaaacacuggcuuguacacaaagaaugguuucacgacaucccacucccauggcaugcaggcgcagacaccggcacaccacacuggaacaacaaagaagcccuagucgaguucaaagacgcacacgcaaaacgccaaacagugguaguccuggguucccaagaaggcgccguccacacagcccucgccggcgcccucgaagcagaaauggacggcgcaaaaggacgccuuagcuccggccaccuaaaaugcagacucaaaauggacaaacuccgccuuaaaggcguaucauacagccucugcacagcugcauucaccuucaccaaaauacccgccgaaacccuccacggaacagucaccgucgaaguacaauacgcaggaacggauggcccuugcaaaguaccagcccagauggccgucgacaugcagacccuaacaccagucggaagacucauaaccgccaauccagucauaacagaguccaccgaaaacuccaaaaugaugcucgaacuagacccuccauuuggcgacuccuacauagucauaggcguaggagaaaagaaaauaacacaccacuggcaccgcuccgguuccaccauuggaaaagcauucgaagcgacaguacgcggggcaaaacguauggcggugcucggcgacaccgccugggacuuuggguccgucggcggcgcccucaauucacucggcaaaggaauacaucaaaucuucggagcggccuucaaaucccuauucggcggcaugagcugguucucccaaauacugaucggcacacuacucauguggcuaggccucaacaccaaaaacggcucaaucucccucaugugccuggcacucggcggcguacucaucuuccuauccacagcagugagugccgacgugggaugcuccguagacuucucgaaaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9366 - RNA, 2365 nt, Artificial Sequence
  ZIKV (isolate Z1106033) Polyprotein(93-804) mRNA Design 3 opt
gggagaaagcuuaccaugcgcaucaucaacgcccgaaaagaaaagaaacgacgaggagcggacacgucagucggcaucguaggauuacugcucaccacagcaauggccgccgaagucacccgcaggggcagcgcauauuacauguaccuugaccgaaacgacgcgggggaagcaauaucguuccccaccacgcuaggcaugaacaaaugcuacauccaaauaauggaccuaggccauaccugcgacgccacaaugucauacgaaugcccaaugcuagacgaaggcguagaacccgacgacguagacugcuggugcaacacaacaagcacaugggucgucuacgggacaugccaccacaagaaaggcgaagcucgcagaagcagacgcgccgucacacugccaagccacuccacccgaaaacuacaaacccgcagccaaaccuggcucgaaagccgcgaauacacaaaacaccucauacgagucgaaaacuggaucuuccgaaaccccggcuucgcccuggcagcagcagccauagccuggcuccuaggcucaagcacaagccaaaaaguaauauaccuagucaugauccuacuaaucgcgccagcguacucaauccgaugcaucggugucagcaaccgagacuucgucgaaggcaugucagguggcaccugggucgaugucguccuggaacacggcgguugcgucacggucauggcccaggauaaaccuaccguagacauagaacuggucaccacgaccguaagcaacauggcagaagugaggagcuauugcuacgaagcaucaauaucggacauggccucugauucgcgaugcccgacccaaggcgaggcauacuuggauaaacaaucagauacccaauacguauguaaacgaacgcuaguagaccgagggugggggaacgguugcggacucuuuggaaaaggcucccuaguaaccugcgccaaauucgcguguucaaagaaaaugacaggcaaaucaauacagccagaaaaccucgaauaccggauaaugcucuccguccacgggucccaacacagcggcaugauagucaacgacacaggccacgaaacagacgaaaauagggccaaagucgaaauaacaccaaacucaccacgagcggaagccacgcucggcggauucggaucccuaggccucgacugugaaccccggaccggccuggacuuuagcgaccuauacuaccucacaaugaacaacaaacacuggcucguccacaaagaaugguuucacgacaucccccugccauggcacgcgggcgcagacacuggcacaccacacuggaacaacaaagaagcucuugucgaguucaaagacgcacacgccaaaagacaaacagucgugguacucggaucccaagaaggagccguacacaccgcccucgccggcgcccucgaagccgagauggacggugccaaaggacgccucagcagcggacaccuaaaaugcagacuaaaaauggacaagcucagacucaagggcguauccuacucccucugcaccgccgccuucaccuucacaaaaauccccgccgaaacccuacacgggaccgucaccgucgaaguacaguacgccggcacagauggccccuguaaaguaccagcccaaauggccgucgacaugcaaacccugacacccgucggacgccuaauaacggccaaccccgucaucaccgaaucaaccgaaaacuccaaaaugaugcucgaacuagacccacccuucggcgacagcuacaucgucaucggggucggagaaaagaaaauaacccaccacuggcaccgauccgggucaaccaucggcaaagcauucgaagccaccguccgcggcgcaaaacgcauggcgguccugggagacacagcuugggacuucggauccgucggcggcgcccuaaacucacucggaaaaggcauucaccaaaucuucggcgccgccuuuaaaagccucuucggcggaaugucgugguucucccagauccuuauaggaacccuacuaauguggcucggcuugaacgccaaaaacggaagcauaagucugaugugccucgcacucggaggcguccuaaucuuccuaagcaccgcaguaagcgccgacguuggauguaguguagacuuuuccaaaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9367 - RNA, 2353 nt, Artificial Sequence
  ZIKV (strain MR 766) Polyprotein(93-800) mRNA Design 3 opt
gggagaaagcuuaccaugagaauaaucaacgcccgaaaagaacgcaaacgcagaggagccgacacaagcauaggcauuaucggccuacuucucaccaccgcaauggcugcagaaaucaccagacgaggaagcgccuauuacauguaucucgacagaucagaugcaggaaaggcaaucuccuucgccaccacacucggaguaaacaaaugccacgugcaaaucauggaccucggacacaugugcgacgcgacaaugucauacgagugccccaugcuagacgagggagucgagccagacgacguagacugcuggugcaacacaaccucaaccugggucgucuacggaacaugccaccacaaaaagggggaagcacgccgaagccgcagagcggucacacuaccaagucacuccacacgcaagcuccaaacccggagccagaccuggcuagaaucccgggaauacaccaaacaccuaauaaaaguagagaacuggauauuucggaacccaggauucgcgcucgucgccguagccaucgcauggcuacuaggcuccagcacaucacaaaaagucauauaccuuguaaugauccuccucaucgcccccgcauacuccauccgcugcauaggagucagcaaucgcgacuucgucgaaggcaugucaggaggaaccuggguagauguaguacucgagcauggcggcugcgucacagucauggcacaagacaaaccaaccguagacaucgaacucgucacaaccaccgugagcaacauggcugaaguccggucauacugcuacgaggcaucaauauccgacauggccuccgacagccgcugcccaacccaaggcgaagccuaccucgacaaacagagcgacacacaauacgucugcaaacgaacccucguagacagaggcugggggaacggaugcggacuauucggcaaaggaucccucguaaccugcgccaaguucacgugcagcaagaaaaugaccggcaaauccauucaacccgaaaaccuagaguaccgcaucaugcuaucaguccacggcagucaacacucagggaugaucggcuacgaaaccgacgaagaccgcgccaaaguggaagucacaccaaacucaccacgcgccgaagcaacacuaggcggguucggaucccugggacucgacugcgagccccgcacgggccuagacuuuagcgaccuuuacuaucuaaccaugaacaacaaacacuggcuaguacacaaagagugguuccacgacaucccacuaccguggcacgcaggggcagauaccggcacaccgcacuggaacaauaaagaagcccuaguagaguucaaagacgcacacgccaaacgacaaaccguaguggucuuaggaucccaggaaggagccguacacaccgcccucgccggagcccuagaagccgaaauggacggcgccaaaggccgccuauuuucgggccaccucaaaugccgccugaaaauggacaaacuacgccuaaaagggguaaguuacucccucugcaccgccgcauucacauucacuaaagucccagccgaaacccuccacggcacaguaacaguagaaguccaauacgccggaaccgacggacccugcaaaauccccguacaaauggcaguagauaugcaaacccuaacccccgucggccgccuaauaacagccaaucccguaauuaccgaauccacagagaacagcaagaugaugcucgaacuugacccacccuucggcgacucguacauagucaucggagucggcgacaagaaaauuacacaccacuggcaccggucaggaucgacaaucggcaaagcguucgaggcaaccguacgaggagccaaaagaauggccguacuaggugacaccgcgugggacuucggcuccguagggggcguauucaacucccuaggaaaaggaauccaccagaucuucggcgccgcauucaagucacuauucggggguaugagcugguucagccaaauccuaaucggcacccuacugguguggcucggucucaacaccaaaaacggaucaaucucccucacaugccuagcauuagggggagucaugaucuuccucagcacagcagucucagccgacgugggaugcagcguagacuucucaaaaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9368 - RNA, 2365 nt, Artificial Sequence
  ZIKV (strain NatalRGN) Polyprotein(93-804) mRNA Design 3 opt
gggagaaagcuuaccaugagaaucaucaacgccaggaaagaaaagaaaagacgaggagcagauaccaguguaggcauaguaggcuuacuccucacuacagcaauggcagccgaaguaacaagacggggcuccgcguacuacauguaccucgaccgaaacgacgcaggagaggcgaucagcuuccccacgacgcuagggaugaacaaaugcuacauacaaaucauggaccucggccacaugugcgacgcaacaaugagcuacgaaugccccaugcuggaugaaggaguggagcccgacgacguagacugcuggugcaauaccacaaguaccugggugguguacggaacaugccaccacaagaaaggcgaagcccgacgaucgcgccgagccguaacucugccgucccauucgaccagaaaacuccaaacaagaucacagacauggcuagagucacgggaauauacaaaacaccucauccgcguagaaaacuggauauuccgaaacccgggcuucgcccucgcagcggcagcaaucgccuggcugcuggggaguucgaccagccaaaaagucauauaccuaguaaugauccuacucaucgcaccggcuuacagcauacgcugcauaggagucucaaaccgagacuucgucgaaggaaugagcggcggcaccuggguagacguaguacucgagcacggcgggugcguaaccgucauggcacaagacaaaccaacaguagacauugagcuagucacgacaacaguauccaacauggcugaaguaagaaguuacuguuacgaagccagcaucagcgacauggcaagcgacucucgcugccccacccaaggagaagccuaccucgacaaacagucagacacccaguacguauguaaacgaacgcuaguagacagaggcuggggcaacggauguggccuuuuuggaaaaggauccuuagucacaugcgccaaauucgccugcagcaagaaaaugacagggaaaucaauccagccagaaaaccuagaauaccggaucaugcucagcguccacggcucccagcacucgggaaugaucguaaacgacacaggccacgaaacagacgaaaaucgcgccaaaguagaaauaaccccgaacagcccccgcgcagaagccacucuaggagguuucggaagccucggucuagacugcgagccccgcaccgggcuagacuucagugaccuauacuaccugacaaugaacaacaaacacuggcuaguccacaaagaaugguuccaugacaucccacuaccguggcacgcaggcgcagauaccggcaccccacacuggaauaacaaagaagcccucgucgaguucaaagacgcgcacgccaaacgccaaacuguggucguacucgggagucaggaaggcgcaguacacaccgcacucgcaggcgcccuagaagcagaaauggacggcgcaaaaggacgccuauccagcggacaccucaaguguagacuaaaaauggacaaacuccgacucaaagguguaagcuacucccuaugcacggcagcauucaccuucacgaaaauaccagcggaaacacuccacggaacaguaacaguagaaguccaauacgcagggacugacgggccaugcaaaguacccgcgcaaauggcaguagacaugcaaacacucacaccggucggacgacuaauaacagcaaacccgguaaucaccgaaagcaccgaaaacagcaaaaugaugcucgaacuagacccacccuucggagacucauacaucgucaucggcguaggagaaaagaaaaucacgcaccacuggcacagaucaggaucgacuauaggcaaagccuucgaagcaacagucagaggggccaaacgcauggcaguacugggggacacagccugggacuucggguccgucggcggggcucuaaacagccuaggcaaagggauacaccaaaucuucggcgcagcauucaaaucacucuucggcggcaugagcugguucagccaaauccuaaucggaacacuacucauguggcuaggguuaaacaccaaaaacggcagcaucagccucaugugcuuagcccuaggcgggguacucauauuucuaagcacagcaguaagcgccgacguaggaugcagcguagacuucucaaaaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9369 - RNA, 2290 nt, Artificial Sequence
  ZIKV (strain ZikaSPH2015) Polyprotein(108-794) mRNA Design 3 opt
gggagaaagcuuaccaugacguccguaggcaucguggggcuccugcuaacgacggccauggcagcagagguaacccgccgaggcucagcauacuacauguaccuagaccgaaacgacgcgggagaagccaucagcuuccccaccacccucggaaugaacaaaugcuacauccaaauaauggaccucggccacaugugcgacgcgacaaugucauacgaaugcccaauguuagacgaaggggucgaacccgacgacgucgacugcuggugcaacaccacaagcacauggguaguauacgguaccugccaccacaagaaaggcgaagccagacgcagccgcagagccguaacccucccgucccacagcacacggaaacuccagacacggagucaaacauggcuggaaucgcgcgaauacaccaaacaccuuauaagaguagaaaacuggaucuuccgaaacccgggcuucgcgcucgccgcagccgccaucgcauggcuccugggguccagcaccagccaaaaagucauauaccucgucaugauccuccucauagcccccgccuacuccauccgcugcaucgguguguccaaccgagacuucguagaaggaaugucgggaggaacauggguagacauaguccucgaacacggcgggugcgucaccgucauggcgcaagacaaaccaacaguagacauagagcuaguaacaacaacagucagcaacauggcugaaguccgauccuacugcuacgaagcaucaaucagcgacauggcaucugacagucgaugccccacacaaggugaagccuaccucgacaaacagucagacacacaauacguaugcaaacgcacacucguagacagaggcuggggcaacggaugcggacuguucggcaaaggcucacugguaacaugcgccaaauucgcaugcagcaagaaaaugacaggcaaaagcauccaaccagaaaaccuagaauaccgcaucaugcuaagcguccacggaagccaacacagcggcaugauagucaacgacaccgggcacgaaacagacgaaaaccgagccaaagucgaaaucacgccaaacagcccccgcgccgaagcaacacuaggcggcuucggaagccucggccuagacugcgaaccacgcacaggacuagacuucagcgaccuauacuaccucacuaugaacaacaaacacuggcuaguacacaaagaaugguuccacgacauaccccucccuuggcacgccggcgccgacaccgguacaccccacuggaacaacaaagaagcccucguagaguucaaggacgcucacgccaaacgacaaaccgucgucguucucggaucccaagaaggcgcaguacacacagcacuagccggcgcccuagaagcugaaauggacggagccaaaggacgccuaucaucaggacauuuaaagugccgccucaaaauggacaaacuccgacucaaaggagucuccuacagccugugcacagcagccuucacauucacaaaaauacccgcagagacccugcacggaaccguaaccguagagguccaauaugccggaaccgacggccccugcaaagucccagcccaaauggcagucgacaugcaaacacucacccccguaggaagacuaaucaccgcaaacccaguaaucaccgaaaguaccgaaaacagcaaaaugaugcuagaacucgaucccccauucggcgacagcuacauagucaucggggucggcgaaaagaaaaucacccaccacuggcaccgcucaggaucaacaauaggaaaagcauucgaggcaaccguacgcggcgccaaacgcauggccguccuaggagacacagcaugggacuuuggcuccguaggaggcgcgcucaacagccucggaaaaggaauacaccaaaucuucggggccgccuucaaaucccuauuuggaggaaugucgugguucucgcaaauccucauaggcacacuccugauguggcucgggcuaaacaccaaaaacggcuccaucagucuaaugugucucgcccucggaggaguccuaaucuuccuaagcacagcuguaagcgcaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9370 - RNA, 2290 nt, Artificial Sequence
  ZIKV (isolate Z1106033) Polyprotein(108-794) mRNA Design 3 opt
gggagaaagcuuaccaugaccagcgucggaauuguaggacugcuccuaacgacagcaauggcagccgaaguaaccagaagaggcuccgcauauuauauguaccucgaccggaacgacgccggagaagccaucuccuucccaaccaccuuagguaugaacaaaugcuacauccaaaucauggaccucggacacacgugcgacgcaaccauguccuacgaaugcccaaugcuagacgaaggcguagaaccagacgacguagacugcuggugcaacaccaccucgacuuggguaguauacggaaccugccaccacaaaaagggcgaagcacgccgaucacgcagagccgucacccuccccucacacagcacccgaaaacugcaaacacggucccaaaccuggcucgaaagccgagaauauacuaaacaccucauaagaguagagaacuggauuuucagaaacccgggcuucgcccucgccgcggcggcaauagcauggcuccuaggcuccuccacaucgcaaaaagugauauaucucgucaugauacuacucaucgccccagcauacuccauacgaugcaucggcguauccaauagagacuucgucgaaggaaugagcggaggcacguggguggacguaguccucgaacacggcggcugcguaaccgucauggcacaagauaaaccaacgguagacaucgaacucgucacaaccaccguaucaaacauggcugaaguccgauccuacugcuacgaagccuccaucagcgacauggcauccgacucacgcugccccacccaaggcgaggccuaccuggacaaacaaucagacacccaauacgucuguaagcgcacccugguggaccggggcuggggcaacgggugcggacucuucggcaaaggcagccucguaacaugcgcaaaauucgccugcagcaagaaaaugacaggaaaaagcauccaacccgaaaaccucgaauaccgaauaaugcuaagcguacacggaucccaacacuccgguaugauaguaaacgacacaggccacgagaccgacgaaaaccgcgccaaagucgaaauuacccccaauucgccccgagcagaagcuacccuaggaggguuuggcucccuaggacuggacugcgaaccacgcaccggacuagacuucuccgaccuauacuaccucaccaugaacaacaaacauuggcuaguacauaaggaaugguuccacgacaucccacuacccuggcacgccggagccgacacaggcacaccccacuggaacaacaaagaggcacucguagaguucaaagacgcccacgccaaaagacaaaccgucgucguucucggcucacaagaaggcgccguacacacggcccucgcuggugcccuggaagccgaaauggacggagccaaaggacgccucuccagcggccaccuaaaaugccgccuaaaaauggacaaacuccgccucaaaggcguauccuacucacucugcaccgccgccuucaccuucaccaaaauacccgcagaaacgcuccacggcacaguaaccgucgaaguacaguacgcuggaacggauggucccugcaaaguacccgcccaaauggcaguagacaugcaaacccucacccccguaggccgccucaucaccgccaacccaguaaucacagaaucaaccgaaaacucgaaaaugauguuagaacucgacccacccuucggagacucauacaucgucaucggcgucggcgagaaaaagaucacgcaccacuggcaccgcagcggcucaacaaucggaaaggccuucgaagcaaccguaagaggagccaaacgcauggccguacucggcgacaccgcaugggacuucggcuccgucggcggagcacuaaacucccucggcaaaggaauccaccaaaucuuuggcgcagcuuuuaaaucccucuucggcggcaugucaugguucucucaaauccucaucggcacacuccuaauguggcucggguuaaacgcuaaaaacggcuccaucagccucaugugccuagcacucggcggaguacuaauauuccuaucaaccgcaguaucagccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9371 - RNA, 2278 nt, Artificial Sequence
  ZIKV (strain MR 766) Polyprotein(108-790) mRNA Design 3 opt
gggagaaagcuuaccaugacauccauaggcaucauaggauuacuacuaaccaccgccauggccgccgaaauaacacgccggggauccgcuuacuauauguaccucgaccgcagugacgccggcaaagcuaucagcuucgcaaccacucuaggaguaaauaaaugccacguucaaaucauggaccuaggccacaugugcgacgccacaauguccuacgaaugccccaugcuagacgaagguguagagccggacgacgucgacugcuggugcaauaccaccagcaccugggucgucuacggcacgugccaccacaagaaaggagaagcacgucguucccgacgcgccguuacucugccaagccacuccacccguaaacuccagaccagaucacaaacauggcuagaguccagagaauacaccaaacaccucaucaaagucgagaacuggauauuccgaaaccccggcuucgcccucgucgccgucgcaaucgccuggcuacucggauccagcacuucacagaaagucaucuaccucgucaugauccuacucaucgccccggcuuacagcauccgaugcaucggagugagcaaccgugacuucgucgaaggcaugucuggcgguaccuggguagacgucguccuagaacacggaggcugcgucaccguaauggcccaagacaaacccacugucgacauagaacucgucacaacaaccgucagcaauauggcagaaguccgcuccuacugcuacgaggccuccauaagcgacauggcaucagacucccgcugcccaacccaaggagaagccuaccuggacaaacaauccgacacgcaauacgucugcaaaagaaccuuagucgaccgcggauggggaaacgggugcggccuauucggcaaaggcucgcucguaaccugcgccaaguucacaugcagcaaaaagaugacgggcaaaagcauacaaccggaaaaccucgaauacagaauaaugcucucgguccacggcucccaacacagcggaaugauuggauacgaaacugacgaggacagagccaaagucgagguaaccccaaacuccccgcgcgcugaagccacccuaggaggcuucggaagccugggccuugacugcgaaccccgaacaggacuggacuucucagaccuguacuacuugaccaugaacaacaaacacuggcugguccauaaagaaugguuccacgacaucccccuuccauggcaugcaggcgcagacaccggcacaccccacuggaacaacaaagaagcccucgucgaguucaaggacgcacacgcaaaacgucaaaccguugucguccuaggcucacaagaaggagcaguucacaccgcccucgcgggcgcccuagaggcagaaauggacggagccaaagggcgccucuucagcggccaccuaaaaugccgccuaaaaauggacaaacuccgccugaaaggaguaucguacucccucugcaccgcagcauucaccuucaccaaaguacccgcggagacccuacacggaacaguaaccguugagguccaauaugccggaaccgacggcccaugcaagauccccguacagauggccguagacaugcaaacacugacaccagucggacgccuaaucaccgcaaaccccgugaucacagaguccaccgaaaacagcaaaaugaugcucgagcucgacccaccuuucggcgacagcuacaucgucauaggagucggagacaagaaaauaacccaccacuggcaccgaagcggguccacgaucggcaaagccuucgaagcgacaguuagaggagccaaacguauggccguacuuggcgacaccgccugggacuucggaagugucggcggcgucuucaacucacucggcaaaggaauccaccaaaucuucggagccgcguucaaaucacuauucggaggaauguccugguucucccaaauccuuauaggaacacuccugguauggcuaggucuaaacaccaaaaacggcagcauaucccuaaccugccucgcgcucggcggugucaugauauuccucucuaccgccgucuccgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9372 - RNA, 2290 nt, Artificial Sequence
  ZIKV (strain NatalRGN) Polyprotein(108-794) mRNA Design 3 opt
gggagaaagcuuaccaugaccaguguaggcaucgucgggcuccuacucaccacggccauggcggcagaggucacccgacguggauccgcauauuacauguaccucgaccgaaacgacgccggggaagcgauauccuucccgaccacccucggaaugaacaaaugcuacauacaaaucauggaccuaggacacaugugcgacgcaacaaugagcuacgaaugcccaaugcucgacgaaggcguggaaccagacgacgucgacugcuggugcaacaccaccuccacauggguaguauacggcacaugccaucacaagaaaggcgaagcccgacgguccagacgcgcugugacacucccaagccacagcacaagaaaacuccaaacacgcucccagaccuggcucgaaagccgggaauauacaaaacaccucauacgcgucgaaaacuggauauuccgcaacccgggguucgcacucgcggccgccgccaucgcauggcuccuuggcagcagcacuucacaaaaagugauauaccucguaaugauccuccugaucgcgcccgccuacuccauccgcugcauaggcgucagcaaccgcgacuucguggaaggaauguccggcggcacgugggucgacgucguacucgaacacggaggcugcgucacaguaauggcccaagacaaaccaacggucgacaucgaacuuguaaccaccacaguaagcaacauggccgaaguccgcucauacugcuacgaggcaagcauauccgacauggcaucagauucacgcugccccacccaaggagaagccuaccuggacaaacaaucagacacacaauacguaugcaaacggacccucguagaccgcggcuggggcaacggcugcggacucuuuggcaaagguucgcucguaaccugcgccaaauucgccugcuccaaaaagaugaccggaaagucaauccaacccgagaaccucgaauaccgaaucaugcucucgguccacgggucccaacacaguggcaugaucgucaacgacacgggacacgaaacagacgagaacagagccaaaguagaaaucacccccaacuccccaagagcggaagcaacacucggcggcuucggcagccuuggccuagacugcgaaccacgaaccggacuggacuucagugaccucuauuaccuaacaaugaacaauaaacacuggcucguacacaaagaaugguuccacgacauaccgcuacccuggcacgcgggugccgacaccggaaccccacacuggaauaacaaggaagcccuagucgaauuuaaagacgcacacgccaagagacaaacagucguaguacuaggcucacaagaaggcgcaguacacacagcccuagcaggagcgcucgaagccgaaauggacggcgcgaaaggccgacugagcagcggccaccuaaaaugccgacuaaaaauggacaaacuacgccuuaaaggagugucauacagccucugcacagcggcauucaccuucaccaagauaccugcagaaacacuucacggcaccguaaccgucgaaguacaauaugccggaacagacggcccaugcaagguacccgcgcaaauggccgucgacaugcaaacccuaacccccguaggacgacuaaucacagcaaaccccgucaucaccgaaucgacagaaaacucaaaaaugaugcuagaacuagaucccccauucggcgacucauacauagucauaggcgucggcgaaaagaaaaucacacaccauuggcaccgauccggaagcacaauaggaaaagcauucgaggcaacaguaagaggcgccaaacgcauggcaguccucggcgacacagcaugggacuucggcagcguaggaggagcacuaaacucccugggaaaaggaauacaccaaauauucggcgccgcauucaaaagccucuucggagggaugagcugguucucccaaauccuaaucgggacccuccugauguggcuaggccuaaacaccaaaaacgggagcaucagccucaugugccuagcacuaggcggcguccuaauauuccuaucaaccgcaguuagcgcaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9373 - RNA, 1582 nt, Artificial Sequence
  ZIKV (strain ZikaSPH2015) Polyprotein(273-723) mRNA Design 3 opt
gggagaaagcuuaccaugucacaaaaagucauauaccuggucaugauccuacucaucgccccagccuacagcauacgcugcauaggaguaucgaaccgagacuuugucgagggcaugagcggaggcacaugggucgacaucguccucgaacacggcgggugcgugacaguaauggcacaagacaaaccgacaguggacauagagcuagucacaaccacggucucgaacauggcagaaguaaggagcuacugcuacgaagccagcauaagcgacauggcaucagacucaaggugcccaacacaaggcgaggcuuaccucgacaaacaaagcgacacccaauacgugugcaaacgcacccuaguagaccgcgguuggggcaacggaugcggccuguucggcaaagggagccuagucacaugcgcgaaauucgccugcagcaagaaaaugacuggaaaaagcauccagccggaaaaucucgaauaccgcauaaugcucagcgugcacgggagccaacacucaggaaugaucgugaacgacaccggacacgaaacagacgaaaacagagcgaaaguagaaauaaccccaaacucaccaagagccgaagccacacuaggaggauucggcucgcuaggccuugacugcgaaccccgaaccgggcuagacuucucggaccucuauuaccucaccaugaacaacaaacacuggcucguccacaaagaaugguuccacgacauaccgcuacccuggcacgcaggcgcagacacaggcacaccccacuggaacaacaaagaggcccucguagaauuuaaagacgcccacgcaaaacgccaaacaguggucguacuagggagccaagaaggggcaguucacacggcccuagccggagccuuagaggcggaaauggacggagcgaaaggacgccucucgagcggccaucuaaaaugucgccugaaaauggacaaacucaggcucaaaggcguauccuacagccuauguaccgccgcguucacauucacaaaaauacccgcagaaacgcuacacggcacaguaacagucgagguacaauacgcaggcacagacgggcccugcaaaguacccgcgcaaauggcgguagacaugcaaacccuaacacccgucggcagacuaauaaccgcaaacccaguaaucacagagagcacagagaacagcaaaaugaugcucgagcucgacccaccguucggagacucauacauagucauaggcgugggcgaaaagaaaauaacgcaccacuggcaccgcuccggaucaaccauaggcaaagccuucgaagccaccguacgaggcgccaaaagaauggccgugcucggagacacagccugggacuucggcucgugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9374 - RNA, 1582 nt, Artificial Sequence
  ZIKV (isolate Z1106033) Polyprotein(273-723) mRNA Design 3 opt
gggagaaagcuuaccaugucccaaaaagucauauaccuaguaaugauacuacucauagccccagcauacagcauccgcugcaucggcguaucaaacagggacuucguagaaggcaugagcggaggaacauggguagacguaguccuagaacacggcggaugcgugaccguaauggcacaagacaaaccgaccguagacauagagcuagucaccacaaccgucuccaacauggcagaagucagaagcuacugcuacgaagcaagcaucagcgacauggccagcgacagccggugcccgacccaaggggaagccuaccuagacaaacagagcgacacacaauacgugugcaaacgcacacucguagaccgcggauggggcaacggcugcggacuguucggcaaaggaagucuagucacgugcgcaaaauucgccugcagcaagaaaaugaccggcaaaucgauccaacccgaaaaccucgaauaccgcaucaugcuaagcgugcacggcagucagcacucggguaugaucgugaacgacacaggacacgaaacagacgaaaaucgcgcaaaaguggaaauaaccccaaacucccccagagccgaggccacccucggaggcuucggcucgcucggacucgacugcgaaccccggaccggccucgacuucuccgaccuguacuaucuaacgaugaacaauaaacacuggcucguacacaaagaaugguuccacgacauacccuuacccuggcacgccggcgcagacacaggaacgccacacuggaacaacaaagaagcccucguggaguucaaagacgcacacgccaagcgccaaaccgucguaguacuaggaucccaagaaggcgccguacacacggcccuagccggagcccuggaagcggaaauggacggagcaaaaggcagacucagcagcggacaccugaaaugccgacugaagauggacaaacuaagacucaaaggcgugagcuacagccucugcacagccgcauucacguucacaaagauacccgcagaaacacuacacggcacaguaacagucgaaguccaauacgccggcacggacgggcccugcaaaguacccgcacaaauggcaguggacaugcaaacgcucacacccgugggaagacuaauaacagcaaacccagucauaacagaaagcacagaaaacagcaaaaugaugcuagaacucgacccacccuucggcgacucguacauagugauaggcguaggagaaaagaaaauuacacaucacuggcaccgcucaggcagcacaauaggcaaagccuucgaagcaacgguccgcggagcaaaacgcauggccgugcucggagacaccgccugggacuucggaucaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9375 - RNA, 1570 nt, Artificial Sequence
  ZIKV (strain MR 766) Polyprotein(273-719) mRNA Design 3 opt
gggagaaagcuuaccaugucgcaaaaaguaaucuaccuagucaugauccuacuaaucgcccccgccuacuccauacgaugcaucggaguaagcaacagagacuucgucgaaggaaugagcggcggaaccugggucgacguaguccuggaacauggcggcugcgucaccgucauggcccaagacaaacccaccguagacauagaacucgucacaacaacaguauccaacauggcugaaguccgaagcuacugcuacgaagccucaauaagcgacauggccucagacagcagaugccccacccaaggagaagcauaccuagacaaacaaagcgauacacaauacguauguaaacgcacacuggucgaccgcggauggggaaacggcugcggccucuucggcaaaggcagucucguaaccugcgccaaauucacaugcagcaagaaaaugaccggaaaauccauacaaccugaaaaccucgaauauagaaucaugcuaucgguccacggaagccaacauucgggcaugaucggcuacgaaaccgacgaagaccgcgccaaaguagaagucacaccgaacaguccccgagcagaagccacccuaggcggcuucggaucccucggccuagacugcgaacccagaaccggauuagacuucagcgacuuauacuaccucaccaugaacaacaaacacuggcucguccacaaagaaugguuccacgacauaccccuaccauggcacgccggcgcagacaccggcaccccgcacuggaacaacaaagaagcccuagucgaguucaaagacgcacacgccaaacgccaaaccguagucguacucggaagccaagaaggcgcaguacacaccgcccuggccggagcccucgaagccgaaauggacggcgccaaagggagacucuucagcggacaccuaaaaugcagacucaaaauggacaaacuccgccuaaaaggcguguccuacucccuaugcacagcagccuucacguucacaaaagugccagccgaaacacuacacggcacaguaaccgucgaaguccaauacgcgggaacagacggcccaugcaaaaucccaguccaaauggcagucgacaugcaaacacucacccccgucggacgacuaaucaccgccaacccagucaucaccgaauccacagaaaacucaaaaaugaugcucgaacucgacccacccuucggagacuccuacaucgucauaggagucggcgacaaaaagaucacccaccacuggcacagaagcggcagcaccauaggcaaagccuucgaagcaacaguacgcggagcaaaacgcauggccguccuaggcgacaccgccugggacuucggguccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9376 - RNA, 1582 nt, Artificial Sequence
  ZIKV (strain NatalRGN) Polyprotein(273-723) mRNA Design 3 opt
gggagaaagcuuaccaugagccaaaaagucauauaccucguaaugauccuacucauagccccggccuacagcauccgcugcaucggaguaucaaacagagacuucguagaaggcaugagcgggggaacauggguagacguaguccucgaacacggaggaugcguaacaguaauggcacaagacaaaccgaccguagacauagaauuagucacaaccacagucucaaacauggccgaaguccgcagcuacugcuacgaagcgagcauaagcgacauggcaagcgauucaagaugccccacccagggggaagccuaccuagacaaacaaagcgacacccaguacguaugcaaacgaacccucguggaccgcggauggggaaacgguugcggccuauucgggaaagggagccuagucacaugcgcaaaauucgcaugcagcaagaaaaugaccgggaaaagcauacaaccagaaaaccuagaauaccgcaucaugcugagcguacacgggagccaacacucaggaaugaucgucaacgacaccggacacgaaacagacgaaaaccgagccaaaguagaaauaaccccuaacucaccacgagccgaagcgacacugggcggauucggcucgcucggacuugacugcgaaccccggaccggacuagacuucucggaucuauacuaccucacgaugaacaacaaacacuggcucguacacaaagaaugguuccacgacauaccccuacccuggcacgcgggcgccgacacaggaacaccccacuggaacaacaaagaagcacucguagaguucaaagacgcacacgccaaacgccaaaccguagucguacuaggaagccaagaaggcgccguccacacggcacuagccggagccuuagaagccgaaauggacggcgccaaaggccggcuaucaagugggcaccugaaaugcagacugaaaauggacaaacucaggcucaaaggagugagcuacagccugugcacggcagcauucacauucacaaaaauaccagcggaaacacuccacgggaccgucacggucgaaguccaauacgcaggcacagacggacccugcaaaguacccgcgcaaauggccgucgacaugcaaacgcucacaccaguaggcaggcucauaacagcaaacccaguaauuaccgaaagcacagaaaacagcaaaaugaugcuagaacucgacccaccauucggagacucauacauagucaucggcguaggagagaagaaaauaacacaccacuggcaccgaucaggcuccacaaucggcaaagccuucgaggcaaccgucagaggagccaaacgcauggcagugcucggagacacggccugggacuucggcucgugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9377 - RNA, 2290 nt, Artificial Sequence
  ZIKV (strain ZikaSPH2015) Polyprotein(108-794)(F398S) mRNA Design 3 opt
gggagaaagcuuaccaugacaagcguaggcauagucggcuuacugcucacgaccgccauggcagcggaaguaaccagacgaggaagcgcauacuauauguaucuggaccgaaacgacgccggcgaagcaaucagcuuccccacaacgcucggcaugaacaaaugcuacauacagaucauggaccucgggcacaugugcgacgccacgaugaguuacgagugccccaugcucgacgagggagucgaaccagacgacgucgacugcuggugcaacaccaccagcaccugggugguauacggcacaugccaccacaagaaaggagaagcacgccgcucucgacgagccguaacacuccccucccacagcaccagaaaacuccagacaagaucacaaacauggcuagaaucacgcgaauacacaaaacaccucauaagggucgaaaacuggauauucagaaaucccggauucgcccucgccgccgccgcgaucgcaugguuacucggcuccuccaccagccaaaaagucauauaccuagugaugauacuccucaucgcuccagcauacuccauccggugcauaggaguauccaaccgagauuuuguggagggaaugucgggaggcaccugggucgacaucguccucgagcacggaggcugcguaacagucauggcacaagacaaacccacagucgacauagagcuaguuaccacaaccguauccaacauggccgaaguaagaucguacuguuacgaagcaagcaucagcgacauggccagcgacagccgcugcccuacccaaggcgaagccuaccucgacaaacaguccgacacacaauacguauguaaacgcacccuagucgacagagguugggguaacggcugcggacucagcggcaaaggcagccucgugaccugcgcgaaauucgccugcucaaagaaaaugaccggcaaauccauacaacccgaaaaccuagaauaccgcaucaugcucucgguccacggaucacagcacucaggcaugauagucaaugacacaggacacgaaaccgacgaaaaccgagcuaaagucgaaaucaccccaaacagcccacgcgccgaagccacgcucggaggcuucggaucacuagggcuagacugcgaaccccgcacaggacuagacuucagcgaccucuacuaccugacaaugaacaacaaacacuggcucguucacaaagaaugguuccacgauaucccccuacccuggcacgcaggagccgacacaggaaccccacacuggaacaacaaggaagcccucguagaguucaaagacgcacacgccaagcgacaaaccgucguaguauuaggcucgcaagaaggcgcaguacacacagcccucgccggcgcacucgaagcagaaauggacggcgccaaagggcgacuaaguagcggccaucucaaaugccgacucaaaauggacaaacuccgacuaaaaggcgucucauacucccuaugcaccgcagcauucaccuucaccaaaaucccggccgaaacacuccacggaaccgucaccgucgaaguacaauacgcaggaacggauggcccguguaaaguucccgcgcaaauggccgucgacaugcaaacgcuuacaccagucggcagacucauaacagccaacccaguaauaaccgaaagcacagaaaauagcaagaugaugcucgaacuagacccacccuucggagacuccuacauaguaaucggcguaggagaaaagaaaaucacccaccacuggcaccgaagcggaagcacgaucggcaaagcauuugaagccaccgugcgcggcgccaagagaauggccguacucggcgacacagccugggacuucgguuccgucggaggcgcacuaaacucacugggcaaaggcauacaccaaaucuuuggagcagccuucaaaagccucuucggaggcaugucaugguucucccagauacucaucggcacccuacucauguggcuaggccugaacaccaagaacgggucaauaucacuaaugugccuagcccucggcggaguacuaauauuccugagcaccgccguaagcgcaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9378 - RNA, 2290 nt, Artificial Sequence
  ZIKV (isolate Z1106033) Polyprotein(108-794)(F398S) mRNA Design 3 opt
gggagaaagcuuaccaugacgagcgucggcaucgucggacugcuucucacaaccgcgauggcagccgaaguaacccgcagaggauccgcauacuacauguaccuagaccgaaacgacgccggagaagccaucagcuucccaaccacccugggaaugaauaaaugcuacauacagaucauggaccugggccauaccugcgacgcgaccauguccuaugagugcccaaugcuagacgaaggaguagagcccgaugacgucgacugcuggugcaacacaacuucgaccugggucguguacggaaccugccaccacaagaaaggcgaagcacggcgaucaagacgagccgucacacuaccaagccacagcacccgcaagcuacaaacacgaagccagacauggcuagaaucccgagaguacaccaaacaccuaauccgaguagagaacuggaucuuccgcaacccaggcuucgcacuugccgcggccgcaaucgccuggcugcucggcagcagcacaagucaaaaggucaucuaccuggucaugauacuccuaauagcgccggccuacagcauccguugcaucggcgucuccaaccgagacuucguugaaggcaugucaggaggcacauggguagacguaguacucgagcacggaggcugcguaaccgugauggcgcaggacaaaccaacaguagacaucgagcuagucaccacaaccgugucgaacauggcugaagucaggagcuacugcuaugaagcaucaauaucagacauggcaagcgacuccagaugccccacacaaggcgaagccuaccucgacaaacaaucugacacccaauacgugugcaaaaggacccuaguagaccggggcuggggcaacgggugcggccuaagcggcaaaggcagccuaguaaccugcgccaaauucgcaugcuccaagaaaaugacaggcaaauccauccaaccagaaaaccuagaauacagaaucauguuaucaguccacggaagccaacacucaggcaugaucgucaacgacaccggacacgaaacagacgaaaaccgcgcgaaaguagaaauaaccccaaacucacccagagcagaagccacacugggcggcuucggcucccucggacuggacugcgaaccccgaaccgggcuagacuucucagaccuauacuaccucacaaugaacaacaaacacuggcucguccacaaagaaugguuccacgacaucccacuccccuggcacgcaggcgccgacaccggcacaccacacuggaauaacaaagaagccuuaguggaguucaaagacgcacaugccaaaagacaaaccgucgucguacuaggcagucaagaaggcgcaguacacacagcgcucgcgggcgcgcuggaagccgaaauggacggagcaaaaggcagguuaucaagcggccaccucaaaugccgacuaaaaauggauaaacuacgccucaaaggcguaagcuacagccucugcacagcagcauucaccuucaccaaaauacccgccgaaacacugcacggcacaguaacagucgaaguccaauacgcaggcaccgacggaccaugcaaaguccccgcccagauggccgucgacaugcaaacccucacucccguagggcgcuuaaucaccgccaacccagucaucacagaauccacagaaaacaguaaaaugaugcucgaacucgacccgccuuucggagacuccuacaucguaaucggcguaggcgaaaagaagaucacccaucacuggcacagaucagguagcaccaucggcaaagcguucgaagcaaccgugcgcggcgcgaaacgcauggcaguucucggcgacacugcaugggacuuuggcucaguaggaggcgcacucaacagccuaggaaaaggaauacaccaaauauucggcgccgcauucaaaagccuauucggcggaaugucaugguucagccaaauacucauuggcacccuccucauguggcugggccucaacgccaaaaacggcuccauaucgcucaugugccucgcacuaggcggcguauuaauauuccucucaacagcugucagcgcaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9379 - RNA, 2278 nt, Artificial Sequence
  ZIKV (strain MR 766) Polyprotein(108-790)(F398S) mRNA Design 3 opt
gggagaaagcuuaccaugaccuccauaggcauaaucggccuacugcuuacgacagcaauggccgcagaaauaacacgacggggcuccgccuacuacauguaccucgaccgcucggacgccggaaaagcaaucaguuucgcuacaacccucggcguaaacaaaugccacguccaaaucauggacuuaggccacaugugcgacgcgacuauguccuacgaaugccccauguuagacgagggcgucgaacccgacgacgucgacugcuggugcaacaccaccucgacauggguagucuacggcacuugccaucacaagaaaggagaagcacgccguucaagacgagcagucacccuacccagccacagcacacgaaaacuacaaacccgcucccaaaccuggcuagaaagccgcgaauacaccaaacaccucauaaaagucgaaaacuggauauuccgaaaccccggcuucgcacucgucgccguagccaucgcauggcuccuaggauccagcaccagccagaaagucauauaccuagucaugauucuacucaucgcaccggcauacuccauacgcugcaucggaguaagcaacagagacuucgucgaagguauguccggcggcacuugggucgacgucguccucgaacacggaggaugcgugacagucauggcacaagacaaaccaacaguggacaucgaacucguaaccaccaccgucagcaacauggccgaaguccgaagcuacugcuacgaagccagcaucagcgacauggcuucagacagccgcugcccaacgcaaggggaagccuaccucgacaaacaaucagacacccaauacguaugcaaacgcacccuggucgaucgcggauggggcaacgggugcggccuuucuggcaaggggucccuaguaaccugcgcaaaauucaccuguucaaagaaaaugaccggcaaauccauccaaccugaaaaccucgaauaccguauaaugcucaguguccacggaucccaacacagcggaaugaucggcuacgaaacagacgaagaccgcgccaaaguagaaguaacccccaacucgccacgagccgaggccacacuaggcgguuucggcucccuaggacucgacugcgaaccucgcacagggcucgacuucuccgaccuauacuaccugacaaugaacaacaaacacugguuaguccauaaggaaugguuccaugacauaccccuccccuggcacgcuggcgccgacacaggcacaccgcacuggaacaacaaagaagcucuaguagaauuuaaagacgcccacgccaaacgacaaacagucguuguccuaggcucccaagagggagcaguacacacagcccuagcgggcgcccuagaagccgaaauggacggcgccaaaggccgccucuucuccggccaccucaaaugucgccucaagauggacaaacuccgccuaaaaggcguaucuuauagccuaugcacagcagcauucacauucacaaaaguaccagccgaaacgcuccacggaacggucacagucgaaguccaauacgccggcaccgacggaccgugcaagaucccaguacaaauggcaguagacaugcagacccuaacaccagucggccgccugauaacugccaacccagucauaaccgaaucgaccgaaaacucaaagaugaugcuugagcuugacccacccuucggcgacuccuacauuguaaucggcgucggggacaagaaaaucacccaccacuggcacagaagcggauccaccauaggaaaagccuucgaagcaaccguaagaggagccaaaagaauggcaguccucggcgauacagcuugggacuucggaagcgucggaggcgucuucaacucccucgguaaaggcauccaccaaauauucggcgcagcauucaagucccuguucggcggaaugucaugguucucacagauacuaaucggaacacugcuaguauggcuaggccucaacaccaaaaacggcagcaucagccuuacgugccuagcacugggcggagucaugaucuuucucuccaccgccguauccgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9380 - RNA, 2290 nt, Artificial Sequence
  ZIKV (strain NatalRGN) Polyprotein(108-794)(F399S) mRNA Design 3 opt
gggagaaagcuuaccaugacaucaguagggauaguaggacuccuccugacaacagccauggccgccgaagucacaagacguggcagcgcguacuacauguaccuggauagaaacgacgcaggcgaagcaaucaguuuccccacaacacugggcaugaacaagugcuacauccaaaucauggaccugggccacaugugcgaugccaccaugagcuacgaaugccccaugcuagacgaaggcgucgaacccgacgacgucgacugcuggugcaacacaacaaguacgugggucguguacggcacaugucaccacaaaaagggagaagcucggcggucccgccgagccgucacgcuccccagccacagcacaagaaaacuccaaacacgaagccaaacauggcuagaaucaagagaauacaccaaacaccucauaagaguggaaaacuggaucuucagaaacccaggcuucgcacuagccgcagccgcaaucgcgugguuacuuggcuccagcacuucucagaaagucauauaccugguaaugauacuacuaauagccccggcauacucgauacgaugcaucgggguaaguaacagggacuucgucgaaggaauguccggaggcacauggguagacguaguccuagaacacggcggaugcguuacgguaauggcccaagacaaaccaaccguagacaucgaacuggucacaacaaccguaagcaacauggcagaggucagaagcuacugcuacgaagccucaauaagcgacauggcaagcgauucccggugcccaacucaaggggaagcauaccuagacaaacaauccgacacacaauacguaugcaaacgcacacuuguagacagaggcugggggaacggcugcggacuauccggaaaaggcucguuagugacaugugcaaaauucgcaugcagcaagaaaaugacagggaaaucaauacaacccgaaaaccuagaauaucggaucaugcucuccguacacggcucacaacacagcggaaugaucguaaacgacaccggacacgaaacagaugaaaaccgagcuaaaguagaaaucacccccaacagcccaagagcagaagcaacacucggaggauucgguucacuuggacucgacugcgagcccagaaccggccucgacuucucagaccuauacuaccuaacgaugaauaacaaacacuggcucguacacaaagaaugguuccacgacauaccccugccguggcacgcaggggcggacacaggaaccccacacuggaacaacaaagaagcgcuggucgaguucaaagacgcccacgcuaaacgccaaaccguaguaguacucggaagccaggaaggagccguacacaccgcccuggccggggcacucgaagcagaaauggacggcgccaaaggccgccuaagcagcggacaccuaaaaugccgucugaaaauggacaaauugcgacucaagggaguauccuacucccuuugcaccgcagcauucacauucacaaaaauacccgccgaaacacuacauggcacaguaacaguagagguccaauacgcaggcacggacgguccaugcaaaguacccgcgcaaauggccgucgacaugcaaacacugacuccagucggcagacucauaaccgcaaaccccguaauaaccgaaaguaccgaaaacagcaaaaugauguuagagcuagacccacccuucggcgacagcuacauaguaauaggagucggcgagaaaaagauaacccaccacuggcaccgcagcggaagcaccaucggcaaagccuucgaagccacaguccgcggggccaaacgaauggcaguccugggcgacacagcaugggacuucgggucagucggcggcgcacuaaacagccucgggaaaggcauacaccaaaucuucggugcagcuuucaaaagccuauucggugggaugucaugguucagccaaauacucauaggcacccuccucauguggcugggccucaacaccaaaaacggcucaauaagccuaaugugccuagcacuaggcggcguccugauauuccuguccacagccguauccgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9381 - RNA, 2290 nt, Artificial Sequence
  ZIKV (strain ZikaSPH2015) Polyprotein(108-794)(N444Q) mRNA Design 3 opt
gggagaaagcuuaccaugaccagcgucggaauagucggacuccuccucacaacagcaauggccgcggaagucacccgacgcggcagcgcuuacuacauguaccucgaccgaaacgacgccggcgaagccaucagcuuccccaccacccugggcaugaacaaaugcuacauacaaauaauggaccuuggccacaugugcgacgcgaccaugagcuacgaaugccccaugcucgacgaaggaguggagccagacgauguagacuguuggugcaacacaacaucaaccugggucgucuacggcacaugccaccacaagaagggagaagccagacgcagccgcagagcaguaacccuaccgucccacucuaccagaaaacuccaaacacgaagccagacaugguuagaaagccgcgaauacacaaaacaccucaucagagucgagaacuggauauucagaaacccaggcuucgcauuagccgcagccgcaaucgccuggcuccuagggagcucaaccucacaaaaaguaauauaccuagucaugauacuacucauagccccggccuacagcauacgaugcauaggugucucaaacagggacuucgucgaaggcaugagcggaggcacguggguggacauaguacucgaacacggcggcugcgugaccgucauggcacaagacaaaccgacaguagacauagaauuggugacaaccacagucuccaacauggccgaagugcguucauacugcuacgaagcaagcaucagcgacauggccucagacagccgaugcccaacccaaggcgaagccuaccuagacaagcaaagcgacacacaauacgucugcaagcggacgcuaguggaccgaggcuggggcaacggcugcggacuauucggcaaaggaagccucguaacaugcgcgaaauucgcgugcagcaagaaaaugaccggcaaauccauccaacccgaaaaccucgaauacagaauuaugcucuccguacacggcagccaacacuccggcaugauuguacaagauacaggccacgagacagacgaaaacagagcgaaagucgaaauaacccccaacucgccccgggccgaagcaacucuaggaggauucggaucgcuagggcuugacugcgaaccccgaacaggacuagacuucuccgaccuguacuaccuaacaaugaacaacaaacacuggcuaguacacaaagaaugguuccacgacauccccuuacccuggcacgcaggcgccgacacaggaaccccacacuggaacaacaaagaagccuuaguggaguucaaagacgcacacgcaaaacgccaaaccguaguaguacuaggaagccaagaaggagcaguacacacagccuuggccggagcguuagaagccgaaauggacggggcaaaaggcaggcuuagcucgggacacuuaaaaugcagacuaaaaauggacaagcuccgccugaaaggaguauccuacucccuaugcacagccgcguucacauucacgaaaauacccgccgaaacuuuacacggcacggucacagucgagguccaauacgcaggcaccgacgggccaugcaaaguacccgcccaaauggccgucgauaugcaaacccuaaccccaguaggaaggcuuauuaccgccaacccagucauaacagaaagcacagaaaacucaaaaaugaugcuagaacuagauccacccuucggagacuccuacaucgucauaggcguuggagaaaagaaaaucacacaccacuggcacagaucaggaagcaccauaggcaaagccuuugaagcgacaguacgcggcgcaaagagaauggccguacuuggcgacacagccugggacuucggcucagucgggggcgcgcugaacagccuaggcaaagggauacaccaaauauucggagcagcauucaaaucccucuucggcggaaugucaugguucucacaaauccucaucggaacccuacugauguggcuaggccuaaacaccaaaaacggcagcaucucacucaugugccuggcccuaggcggaguccucaucuuccucuccaccgccguaucggccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9382 - RNA, 2290 nt, Artificial Sequence
  ZIKV (isolate Z1106033) Polyprotein(108-794)(N444Q) mRNA Design 3 opt
gggagaaagcuuaccaugaccagcguaggaaucgucgggcuacuacucacaacagcaauggcggccgaggucacccgcagaggauccgccuacuacauguaccuagaccgaaacgacgcaggcgaagcgaucagcuucccaacuacacuaggaaugaacaaaugcuacauacaaauaauggaccuuggacacacaugcgacgccaccaugagcuacgaaugcccaaugcuggacgagggaguugagcccgacgauguggacugcuggugcaacaccacgagcacguggguugucuauggcacaugccaccacaagaaaggcgaagccagacgcagccgacgcgcaguaacacucccaucacacucaacaagaaaacuucaaacaagaagccaaaccuggcuggaaagccgagaauacacaaaacaccugauacgagucgaaaacuggaucuuccggaaccccggauucgcacucgcggcugcagccaucgccuggcuacucggcuccagcacaucccaaaaagucaucuaccucgugaugauauuauugauugcacccgcauacucaaucagaugcaucggcguaagcaaucgugauuucguggaggggaugucaggcggcaccuggguggacgucguacuagaacacgggggaugcgucacaguuauggcccaagacaaaccaacagucgacaucgaacugguaaccacaaccguaagcaauauggccgaggugcgaucauacuguuacgaggccagcauaagcgacauggcuucagacucccgcugccccacccaaggagaagcguaccuagacaaacaaucagacacacaauacguaugcaaaaggacccuagucgaccgaggauggggcaacggaugcgggcuauucggcaagggcagccuaguaacuugcgccaaauucgcaugcuccaagaaaaugacaggcaaaagcauacaaccagaaaaccuagaauacagaaucaugcuaucgguacacggaagccaacacagcgggaugauaguacaagacacgggacacgaaacagacgaaaacagggccaaaguagagauaacgcccaacaguccccgggcagaagcaacacuaggcggcuucggaucacuaggccuagacugcgaaccacgcacaggccuagacuucagcgaccucuacuaccucaccaugaacaacaaacacuggcugguacauaaagaaugguuccacgacauaccguuaccguggcacgcaggcgcagacaccggcacaccccacuggaacaacaaagaggcccucguagaguuuaaagacgcccacgcaaaacggcaaacagucguaguccuaggaucgcaagagggcgcaguccacacagcacuagcaggcgcccuagaagccgaaauggacggagccaaaggacgacucuccuccggccaccuaaaaugcagacucaagauggauaaacuccgacuaaaaggcgucuccuacucgcucugcacagcggcauuuacauucaccaaaauaccagccgaaaccuuacacggaaccguuaccgucgaaguacaguacgcaggaacagacgggccaugcaaagucccggcacagauggccgucgacaugcaaacccucaccccagucggccgacucaucacggccaaccccgugaucacagaaucgaccgaaaauucaaaaaugaugcuagaacuugacccacccuucggagacagcuacaucgucauaggcgucggcgagaagaaaaucacccaucacuggcaccgcagcggaagcaccauaggaaaggccuucgaggcaaccgugagaggagcgaaacgaauggccguacucggcgacacugcaugggacuucggcuccgucggcggagcucuaaacucccugggaaaaggaauccaccaaauauucggagccgccuucaaaagccuauucggaggaauguccugguucucacaaauacuaauaggcacccuccugauguggcuaggacuaaacgcaaagaacggguccauaagccugaugugccuggcgcucgggggcguccuaaucuuccuauccacagcaguauccgcaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9383 - RNA, 2290 nt, Artificial Sequence
  ZIKV (strain NatalRGN) Polyprotein(108-794)(N444Q) mRNA Design 3 opt
gggagaaagcuuaccaugacaagcguaggaaucgucgggcuccugcuaacgacagcaauggcagcagaagucacucgacgaggcuccgcauacuacauguaccuggaccgaaacgacgccggagaagccauauccuucccaaccacacuuggcaugaacaaaugcuauauccaaauaauggaccucggacacaugugcgaugccacaaugucauacgaaugcccaaugcucgacgaaggcguggaaccagaugacgucgacugcuggugcaacaccacaagcaccugggucguauacgguacaugccaccacaagaaaggcgaagcacggaggagccgacgagcaguaacccuaccaagccacuccacucgcaaacuccaaacccgaagccaaaccuggcuagaaagccgagaauacaccaaacaccuaauacggguagaaaacuggaucuuccgaaaucccggcuucgcacuagccgccgcggcaaucgcauggcucuuaggcucaaguacaagccaaaaaguaaucuaccucgucaugauucuacuaaucgcccccgccuacuccauacgcugcaucggaguaagcaacagagacuucgucgaagggaugucaggcgguaccuggguggacgucguacuagaacacggcggcugcguaaccgucauggcccaagacaaaccaacgguagacaucgaacucgucaccaccacagucagcaacauggccgaagugcgcuccuauugcuaugaagcaucaauaucagacauggcuucagacucacgaugcccaacacaaggagaagccuaccuagacaaacagucagacacccaauacguaugcaaacgaaccuuagucgaucgcggauggggaaacggcugcggccucuucgggaaaggcucgcuagugacaugcgccaaauucgcaugcuccaagaaaaugaccggcaaaucaauccaaccagagaaccuagaguauaggauaaugcucucaguccacggaucgcaacauagcggaaugauaguccaagacacgggacacgagacggacgagaaccgcgcaaaagucgaaauaacaccaaacagcccccgagcggaagcgacacuaggcggguucggaagccuaggacuagacugcgagccacgaacgggccuggacuucucagaccuauacuaccucaccaugaacaacaaacauuggcuaguccacaaagaaugguuccacgacaucccccucccauggcacgcgggugcagacacaggcacuccccacuggaacaacaaagaggcccuggucgaauuuaaagacgcucacgcgaaaaggcaaaccgucguaguacugggcucacaagaaggcgcgguccauacagcccucgcaggcgcauuagaagccgaaauggacggagcaaaaggacgccuauccucaggccaccucaaaugccgacucaaaauggacaaacuacggcugaaaggaguauccuacagccucugcacagccgcauucaccuucaccaaaauccccgccgaaacccuacacgggaccguaacaguagaaguacaauacgcagggacagauggcccaugcaaagucccggcccagauggccgucgacaugcaaacacuaacaccgguuggacgccucaucacagccaaccccgucauuacagaaucaacagagaacuccaaaaugaugcucgaacuagacccacccuucggagauucauacaucgucauaggcgucggagaaaagaaaauaacucaccacuggcaccgcagcggcagcaccaucggcaaagcauucgaagccacaguccgaggagcaaaaaggauggcaguacucggagacaccgcaugggacuuugguagcgucggcggcgcccuaaacucacuaggaaaaggaauacaucaaaucuucggagcagcauuuaaaagccucuucgguggaaugagcugguucucccaaauacuaaucggaacccuccugauguggcuaggacugaacaccaaaaacggaagcaucagccugaugugccucgcgcucgggggcguacuaaucuucuuaagcacagcaguaucggccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9384 - RNA, 2290 nt, Artificial Sequence
  ZIKV (strain ZikaSPH2015) Polyprotein(108-694)-Cterm-JAEV1-E(400-500) mRNA Design 3 opt
gggagaaagcuuaccaugacaagcguuggaaucgucgggcugcuacucacgaccgccauggccgcugaagucacgcgcaggggcucagcauacuacauguaccucgacagaaacgacgcgggcgaagcaaucagcuucccaacaacacucggcaugaacaaaugcuacauacaaauaauggaccucggacacaugugcgacgcaacaaugucguacgaaugccccaugcucgacgaaggaguugaacccgacgacguagacugcuggugcaacacaacaaguaccugggucguguacggaaccugccaccacaagaaaggagaagcuaggcggucacgacgcgcaguaacccugccaagccacuccacgagaaaacuacaaacccgcagccaaacauggcuggaaucacgcgaauacaccaaacaccucauccgcguggaaaacuggauuuucagaaacccaggcuucgcgcuagccgccgccgccauagcauggcuacucgggucauccacaagccaaaaagucauauaccucgucaugauccuguuaaucgccccagcguacagcauacggugcaucggcgucagcaaucgagacuucguggaaggcauguccggcggaaccugggucgacaucguccucgagcacggagggugcguaaccgucauggcacaagacaaaccaacaguagacauagaacucgugacaacaacaguaucuaauauggccgaaguccgcuccuacugcuacgaagccagcaucucagacauggccuccgacucacgcugcccaacgcaaggggaagcauaccucgacaaacaauccgacacccaauacguaugcaaaagaacacucguagaccgaggguggggaaacggaugcggccuauucggaaaaggcagccucguaaccugcgccaaauucgcgugcuccaagaaaaugacgggcaaaagcauccaacccgaaaaccucgaauacagaaucaugcuguccguccacggcucccaacacuccgggaugaucguaaacgacacgggacacgaaaccgacgaaaaccgagccaaaguagaaaucaccccaaacagucccagagccgaagccaccuugggugguuucggaagccucggccucgacugcgaaccgagaacaggccuggacuucagcgaccucuacuaccucacaaugaacaacaaacacugguuaguccauaaagaaugguuccacgacauaccucuccccuggcacgccggcgcagacaccggaaccccacacuggaacaacaaagaggcacuuguagaguucaaagacgcccacgccaaacgacaaaccgucguaguccucggaucacaagaaggcgcgguacacaccgcacucgcgggggcccuggaagcagaaauggacggcgccaagggcagacucagcuccgggcaccucaaaugcagacugaaaauggacaagcuccgacucaagggagucucuuacucacuaugcaccgccgcguucacauucacuaaaaucccagccgaaacacuccacgguaccgucaccguagaaguccaguaugcaggcacugacggcccgugcaaagugcccgcccaaauggccguagacaugcaaacacucaccccaguaggaaggcuaaucacugcaaaccccgugauaacagaaucaaccgaaaacucaaaaaugaugcuagaacuagacccacccuucggagacuccuacaucgucauaggagugggggaaaagaaaaucacacaccacuggcacagguccggcuccacacucggcaaagccuucuccaccacccuaaaaggcgcacaacgccuagcagcccuaggagacacggcgugggacuucggguccauaggcggcguauucaacuccaucggacgcgcaguccaccaagucuucggcggagccuuccgaacccuauucggcggaaugagcuggauaacccagggacugaugggagcacuacugcuauggaugggcgucaacgcacgcgacagaagcauagcacuagccuuccucgccacuggcggaguacucguauuccuggcaacaaacguccacgcaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9385 - RNA, 2290 nt, Artificial Sequence
  ZIKV (isolate Z1106033) Polyprotein(108-694)-Cterm-JAEV1-E(400-500) mRNA Design 3 opt
gggagaaagcuuaccaugaccagcgucggaaucgucggacuccugcuaacaacagcaauggcagccgaagucacgcgaaggggaucggcauacuacauguaucucgaccgcaacgacgcgggcgaagccaucagcuucccaacaacgcugggcaugaacaaaugcuacauacaaauuauggaccuaggacacacaugcgacgcaacaaugagcuacgaaugccccaugcucgacgagggcguugaacccgacgacgucgacugcugguguaauacgacauccacauggguaguauacgggaccugccaccacaagaaaggggaagcgcgccgguccaggagggccgucacucucccgagccacaguaccaggaaacuacaaacccgcagccaaaccuggcucgaaagccgugaauauacaaaacaccuaauucgcguagagaacuggaucuuccgcaaccccggauucgcccuggcagcagcagcaauagccuggcuguugggcucaagcacaagccaaaaggucauauaccugguaaugauccuacuaauagcaccagcauacuccaucagaugcauaggcgugagcaaccgagacuucguugaaggaaugucgggcgggacaugggucgacguaguccuagaacacggaggcugcguaacggucauggcucaagacaagcccacggucgacauagagcuaguuacuacaacaguaagcaacauggccgaagucaggagcuauugcuacgaagccuccaucucagacauggcauccgacucccggugccccacccaaggagaagcauaccucgacaaacaaagcgacacgcaauacgucugcaaaaggacccucgucgaccgcggauggggcaacggaugcgggcuauucggaaaaggaucccucgugaccugcgccaaauucgccugcuccaagaaaaugacaggcaaaagcauacaacccgagaaucuggaauacagaauuaugcucagcguacacggcucacagcacagcggcaugaucguaaacgacaccggacacgaaacggacgaaaaccgagcaaaagucgaaauaacaccaaacagcccucgcgcggaagcgacccugggaggauucgggagccuaggacuggacugcgaaccccgcacgggccuagacuucagcgaucucuauuaccuaaccaugaacaacaaacacuggcuagugcacaaagagugguuccacgacaucccacucccguggcacgccggagccgacacaggaaccccgcacuggaacaacaaagaggcccuuguagaguucaaagacgcacaugcgaaaagacaaacagucguaguccugggcucacaagaaggagccguacacacagcacuagcaggcgcucucgaagccgaaauggacggagccaaagggcgccuaagcuccggccaccugaaaugccgccuaaaaauggacaaacuacgccucaagggaguaucauauucccuaugcaccgcagccuucacauucacaaaaaucccagccgaaacacuacacggcacaguaacagucgaaguacaauacgcaggaacagacggcccaugcaaaguccccgcccaaauggcgguugacaugcaaacccuaaccccagucggacgccugaucacagcaaacccagucaucaccgaauccacagagaacucaaaaaugaugcucgaacuagacccgcccuucggcgauagcuacaucguaauagggguaggagaaaagaaaaucacacaucacuggcaccgcagcggaagcacccuaggcaaagcauucucgaccacacugaaaggagcacaacggcucgcagcccucggagacaccgccugggacuucggauccauagggggagucuucaacucgaucggccgcgcaguacaucaaguauucggcggcgcguucaggacacuauucggaggaaugagcuggaucacacaaggccuaaugggagcccuacuacucuggaugggcgucaacgcacgagaccggagcauagcccuagcauuccucgccaccggaggcguacucguauuccuagcaacgaacguacacgcgugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9386 - RNA, 2278 nt, Artificial Sequence
  ZIKV (strain MR 766) Polyprotein(108-690)-Cterm-JAEV1-E(400-500) mRNA Design 3 opt
gggagaaagcuuaccaugaccagcaucggaauaaucggacuccuccuaacgaccgcaauggcagcagaaauaacacgacgaggcucagccuacuacauguaccuggaccgcagugacgcaggaaaagcgaucucguucgcaacuacccucggcgucaacaaaugccacguccaaaucauggaccucggucacaugugcgacgcaaccauguccuacgaaugcccaauguuagaugaagguguagaaccagacgacguagacugcuggugcaacacgacgucaaccugggucgucuacgguaccugccaucacaagaaaggcgaagcccgccgcagcagacgcgccguaacccuaccaagccacucaacacgaaaacuccagaccagaucacagacguggcuggaaucccgagaauauaccaaacaccuaauaaaagucgaaaacuggauauucagaaaucccggauucgcccucgucgcaguagcaaucgcuuggcuacucggauccagcacaagccaaaaaguaaucuaucucguaaugauacuccuaauagcacccgcauacuccauaagaugcaucggcguaagcaaccgagacuucgucgaaggaaugucgggcggcacauggguagacgugguacuagagcacggaggauguguaacggucauggcacaagauaaaccgaccgucgacauagaacucguaacaaccaccguauccaacauggccgaagucagaagcuacuguuacgaagccuccaucucagacauggccucagacucccgcugccccacacagggcgaagcauaccuagacaagcaauccgacacacaauaugucugcaaacgaacgcuagucgaccgaggaugggggaacggaugcggacucuuugguaagggcucacucguaaccugcgccaaauuuaccugcagcaagaaaaugaccggaaaaagcauccaaccggaaaaccuagaauacagaauuaugcucucgguccacggcucacaacacagcgggaugauaggcuaugaaaccgacgaagacagagccaaaguagaggucacaccaaacagccccagggcagaagcaacccucggcggcuucggaucccucggccucgacugugaaccccgaaccggccuggacuucuccgaccucuacuaccugaccaugaacaacaagcacugguuaguucacaaagaaugguuccaugacaucccccuacccuggcacgccggcgcagacaccggcaccccacacuggaacaacaaagaagcccuagucgaguucaaagacgcacacgccaaacggcaaacagucguaguccuuggcucccaagaaggagccguacacaccgcacucgccggagcacuagaagcagaaauggacggugccaagggccgacucuucagcggacaccuaaaaugccgccucaagauggacaagcuaagacucaaaggggucuccuacucucucugcacugcagccuucaccuucacgaaaguccccgcagaaacccuccacgggacugucaccguagaaguacaauacgccgguaccgacggcccaugcaaaaucccaguacaaauggcaguagacaugcagacacuuacacccguaggacgccuaauaacagcaaaccccgucauaaccgaaagcacagaaaacuccaaaaugaugcuagaacuagacccucccuucggagacagcuacauagugaucggcgucggcgacaagaaaaucacacaccacuggcacagaagcggcagcacccuaggcaaagcauucucuacaacccucaaaggcgcccaacgacuagcagcacucggagacacagccugggacuucggaagcaucggaggcgucuucaacagcauaggacgcgccguacaccaagucuucggaggcgcuuuccgcacccucuucggcggaaugagcuggaucacccaagggcugaugggcgcacuacuacucuggaugggaguaaacgcacgggacagaagcaucgcccuggcuuuucucgccaccggcggcguccucgucuuccuagcaacgaacguacaugccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9387 - RNA, 2290 nt, Artificial Sequence
  ZIKV (strain NatalRGN) Polyprotein(108-694)-Cterm-JAEV1-E(400-500) mRNA Design 3 opt
gggagaaagcuuaccaugaccuccgucggcauaguaggccuacuacucaccaccgccauggccgccgaagucacgcgcagaggaagcgcauacuacauguaccuggaccgaaacgaugccggcgaagcgaucuccuucccaaccacucucgggaugaacaaaugcuauauccaaaucauggaccuaggacacaugugcgaugcaaccauguccuacgagugcccaaugcuagaugaaggagucgaaccagacgacguggacugcuggugcaacaccaccucgacauggguagucuacggcacaugccaccauaagaagggggaagccagacgcuccagacgagcaguaacgcuccccucacacucaacgagaaaacuccaaaccagaagccagacauggcucgaaucacgcgaguacaccaaacaccucauccgcgucgaaaacuggaucuuccgaaauccuggcuucgcccuagcagcagccgccauagccuggcuacucggcagcagcaccagccaaaaaguaaucuaucuaguaaugauccuacuaaucgcacccgccuacagcauacgcuguaucgguguaucaaaccgcgacuuugucgaaggaaugucaggcggcacaugggucgacguaguccuagaacacggcggcugcgucacaguaauggcacaagacaaaccaacggucgacauagagcuaguaacaacaacgguauccaacauggccgaaguccgaucauacugcuacgaagccuccaucucagacauggcaucggacucccgcuguccgacacaaggagaagcguaccuagacaaacaaucggacacccaauacguaugcaaacgaacucuaguagaccgcggcuggggaaacggauguggccucuucgguaagggcucacucgugaccugcgcaaaauucgcaugcagcaagaaaaugaccggcaaauccauccaaccugaaaaccuagaauaccgaauaaugcuaucaguccacgguucacaacacuccggaaugaucguaaacgacaccggccacgaaacagacgaaaaccgagccaaaguagaaauaacccccaacagcccacgagcggaagcaacccuagggggauucggcucacuggggcuggacugugaacccagaacgggccuagacuucagcgaccucuacuaccuaacaaugaacaauaaacacuggcuaguacacaaagaaugguuccacgacaucccccuccccuggcacgcaggcgccgauaccggcacuccccacuggaacaacaaagaagcucuggucgaguucaaagaugcacacgcuaaaagacaaaccguagucguccuaggcucccaggaaggugcgguccacaccgcccucgcaggagcccucgaggcagaaauggacggcgcuaaaggacgccuaagcuccggccaccucaaaugccgccuaaaaauggacaaguuacgccucaaaggagugaguuacagccucugcacagcggccuucaccuucacaaaaaucccagcagaaacacuacacggaaccgucaccgucgagguucaauacgcaggcacggacgggccaugcaaagucccagcccaaauggccgucgacaugcaaacucuaaccccaguaggccgccucauuacagccaacccaguaaucacugaauccaccgagaacagcaaaaugaugcucgaacucgacccaccauucggggacuccuacaucgucaucggcguaggcgagaagaaaauaacacaccacuggcaccgcucggggagcacucucggcaaggccuucucaaccacacucaaaggcgcccaacgacucgccgcccuaggagacaccgcaugggacuucggcucaaucggcggagucuucaacagcauaggccgcgccguacaccaaguauucggcggagcauuccgcacacuguucgggggaauguccuggauaacacaaggccucaugggcgcccuauuacuuuggauggggguaaacgcccgagaccgaagcauagcccuagccuuccuagccaccggagggguacucguauuuuuagccaccaacguccacgcaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9388 - RNA, 2365 nt, Artificial Sequence
  ZIKV (strain ZikaSPH2015) Polyprotein(93-804) mRNA Design 3 opt
gggagaaagcuuaccaugcgcaucauaaacgcccgcaaggaaaagaaaagacgcggggccgacacauccgucggaauaguaggccugcuacuaacaaccgccauggccgccgagguaacaagacgcggcagcgccuauuacauguaccucgaccgcaaugacgcaggagaagcaauaucauuccccaccaccuugggaaugaacaaauguuacauccaaaucauggaccuaggacacaugugcgacgcaacaaugaguuacgagugcccaaugcuggacgaaggaguggaaccagacgacgucgacuguuggugcaacaccaccagcaccuggguaguauacggcacaugccaccacaagaaaggcgaagcacgacgaagccggagagcgguaacccuccccagccacuccacacgcaaacugcaaaccagaucccaaaccuggcuagaaagccgcgaauacacaaaacaucucauacgcguggaaaacuggauauuuagaaacccaggcuucgcccuagccgccgccgcaaucgcauggcuccucggaagcuccaccagccaaaaaguuauuuaccugguaaugauacuguugauagcacccgccuacagcauucgguguaucggcguaagcaacagagacuucgucgaaggaaugucgggaggcaccugggucgacaucguccuagagcacggcggcugcguaaccgucauggcacaagacaaaccaacagucgacaucgagcucgucaccaccaccguaucaaacauggccgaagugcgcagcuacugcuacgaagcaagcauaucagacauggcuucugacagcagaugccccacacaaggagaggccuaccuagacaagcaauccgacacacaguacguaugcaaacgaacccuagucgaccgaggauggggaaacggaugcggauuauucggcaagggaucccuagucacgugcgcaaaauucgccugcagcaagaaaaugaccggaaaauccauacaaccagaaaaccucgaauacaggauaaugcucagcguacacggcucacaacacaguggcaugaucgucaacgacaccggacaugaaaccgacgaaaaccgcgccaaaguggaaaucaccccaaacagcccacgggcagaggcaacacucggcggcuucggcucccuaggacuggacugcgaacccagaaccggacucgacuucuccgaccucuacuaccuaacaaugaacaacaaacauuggcuggugcacaaagaaugguuccacgacauaccgcuucccuggcacgccggcgccgacacgggaacaccccacuggaacaacaaagaagcccucguagaguucaaagacgcacacgcaaaacgacaaacggucgucguccuagggucacaagaaggcgccguccacaccgcacuagccggcgcacucgaagcagaaauggacggcgccaaaggacgacucucaucaggccaccuaaaaugccgccuaaaaauggacaaacuacgccugaaaggcgucagcuacagccuauguaccgccgcauuuacguuuaccaaaauacccgcagaaacacuccacggcacagucacagucgaaguccaauacgccgggaccgacggccccugcaaaguaccggcccagauggcaguggacaugcaaacgcucaccccaguuggaagacugauaaccgcaaaccccgucaucaccgagagcaccgaaaacucaaaaaugaugcuagaacucgacccacccuucggcgacuccuacaucgucaucggcgucggugaaaagaaaauaacacaucauuggcacagauccggaagcaccaucggaaaagcauucgaagccaccguccgaggagcaaaaagaauggcgguccucggcgacaccgcgugggacuucggaagcgugggcggcgcccucaacagccuagggaaagggauacaccaaauuuucggugcagccuucaaaucacuauucggcggaaugagcugguucucccaaauacuaaucgguacacuacucauguggcuaggccuaaacaccaaaaacggcagcauaagccuaaugugucucgcucuaggcggcguacucaucuuccucucuacagcagucagcgccgacguaggcugcagcgucgacuucagcaaaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9389 - RNA, 2362 nt, Artificial Sequence
  ZIKV prME variant mRNA Design 3 opt
gggagaaagcuuaccaugaucaucaaugcucgaaaagagaagaaacgacguggcgcagacacaucggucggcauaguaggacucuuacucacaaccgcaauggcagcggaagucacccgacgcgggagcgccuacuacauguaccucgaccgcaacgaugccggugaggcaaucucauuccccacgacacuaggaaugaacaaaugcuacauccaaaucauggaccucgggcacaugugcgaugcgacuauguccuaugagugcccaaugcuggaugaaggagucgaacccgacgacguagacugcuggugcaacacgaccaguacaugggucguauacggaacgugccaccacaagaaaggcgaagcccgccgcagccgucgagcagugacccuacccagccacucaacacgcaaacuccaaacacguucacaaaccuggcucgaaagccgagaauacacgaaacaccuaauaagagucgaaaacuggaucuuuaggaacccgggcuucgcacuagcagcggccgcgauagccuggcuccuggggagcucgaccucacaaaaagucauauaccugguaaugauccuacugaucgccccggcauacucuauacgcuguauaggcgucucgaaccgcgacuucguagaaggaaugagcggagggacaugggucgacauaguccuagaacacgggggcugcguaacagucauggcccaagacaaaccaaccgucgacaucgaauuagucacaacuacagucucgaacauggccgaaguacggagcuacugcuacgaagccagcaucagcgacauggccucagacagccgaugcccaacacaaggcgaagcauaccucgacaaacaaagcgacacacaguacguaugcaaacgcacccuaguagacagaggauggggaaacgguugcggacucuucgggaaaggaagccuagucacaugcgcaaaauucgccugcagcaagaaaaugacuggcaaaaguauacaaccagaaaaccucgaauaccgaaucaugcucagcgugcacggaucacaacacucugggaugauaguaaacgacaccggacaugaaaccgaugaaaaccgcgccaaaguagagaucacaccaaacagccccagggccgaagccacccucggaggcuucggcagccugggacuagacugcgaaccccgcacaggccucgacuucucagaucuauacuaccucacaaugaacaacaaacacuggcuaguccacaaagaaugguuccacgacaucccucuaccguggcacgccggcgcagacaccggcaccccacacuggaacaacaaagaagcccuaguggaguucaaagacgcacacgcaaagcgccagacaguaguaguacuagggagccaagaaggagcaguccacacagcacucgccggggcccuagaagccgaaauggacggcgcaaagggacgccuguccucgggacaccuaaaaugccgacugaaaauggacaagcuccgacuaaaaggcguaagcuacagucuaugcacagccgcguucacauucaccaaaaucccugcagagacgcugcacgggaccguaacaguagaaguacaauacgccggcacggacgggcccugcaaaguaccagcacaaauggccgucgacaugcagacacucacacccguaggcagacuaaucacagcaaaccccguaaucaccgagucgacagaaaacaguaagaugaugcuggaacucgacccacccuucggagacuccuacauaguaauaggcgugggugaaaagaaaaucacacaccacuggcaccgaagcggaagcacaauaggcaaagccuucgaagcaacaguaagaggggcaaaacgcauggccguccucggcgacacagcgugggacuucggaagcgucggaggcgcacucaacucccucggaaaaggaauccaccaaauauucggagcagccuucaaaucccuauucggcgggaugaguugguucagccaaauacugauaggcacccugcuaauguggcuaggacucaacaccaaaaacgggucaauaucacucaugugccucgcgcuaggaggagucuuaaucuuccuaucaacagcugucagcgccgauguaggaugcuccguugacuuuucaaaaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9390 - RNA, 2359 nt, Artificial Sequence
  ZIKV prME variant mRNA Design 3 opt
gggagaaagcuuaccaugaucaacgcaaggaaggagaagaaacgccgaggggccgacacgagcgugggcauagucggccuccuacucacaaccgcgauggcggcagagguaacaagaagaggcagcgccuacuacauguaccucgaccgcaacgacgcaggagaagcaauaucauucccaaccacccuaggcaugaacaaauguuacauacaaaucauggaccuaggccacaugugcgacgccacaauguccuacgaaugcccaaugcuagacgagggcguagagcccgacgacgucgacugcuggugcaacaccacuagcaccugggugguauauggcacuugccaucacaagaaaggagaagcccgccgcuccaggagagcaguaacccuccccagccacagcacaagaaaacuccaaacaagaucccaaacuuggcuggaaucgagagaauacaccaaacaucuaauaagagucgagaacuggaucuuccgaaacccaggauucgcacuagccgcagcagcaauagccuggcuucuaggcucaagcacaucccagaaaguaaucuaccuagucaugauacucuugauagcaccagcauacucaauccgcugcauaggaguaagcaaccgcgacuucgucgaaggaaugagcggaggcacaugggucgauaucguacucgagcacggaggcugcguuacggucauggcacaagacaaacccaccguagacaucgaacugguaaccacaacagugagcaacauggcagaaguacgcagcuacuguuacgaagcaucaaucucagacauggcaucagacagccgaugcccaacacaaggcgaagcguaccucgacaaacaaagcgacacacaauacguauguaaacggacccuggucgaccgaggauggggcaacggaugcggacuguucggcaaaggaucgcucguaacaugcgcaaaauucgcaugcagcaagaaaaugaccggaaaaagcauacaacccgagaaccucgaauaccggaucaugcucucgguacacgggucccaacacagcggcaugauaguaaacgacacgggacacgaaacagacgagaacagagcgaaagucgaaauaacaccaaacagcccccgagcagaagcgacccugggcggcuucgggucccugggacuagacugcgaaccaagaacuggacuagacuuuuccgaccuauacuaccuaaccaugaacaacaaacacuggcugguacacaaagaaugguuccaugacaucccgcucccauggcacgccggggccgauaccggcacaccccacuggaacaacaaagaagcccuagucgaauuuaaagacgcccaugccaaaagacaaacagucgucguacugggcagccaagagggcgccguacacaccgcgcucgcaggcgcacuagaagccgaaauggacggagcaaaaggaagacuaagcucaggccaccuaaaaugcagacucaaaauggacaaacugcgccugaaaggagugucguacucccuaugcacagcagccuucaccuucacaaaaaucccagcagagacgcuacacgggacagucaccguagaggugcaauaugcagggacagacggcccaugcaaaguacccgcccaaauggccguagacaugcaaacccuaacaccagucggacgccucauaacagcaaacccaguaauaacagaaucuacggagaacucgaaaaugaugcuggaacuagauccgcccuucggcgacagcuacaucguaauaggagucggugaaaagaaaauaacacaccacuggcacagauccggcagcacgauaggaaaagccuucgaggcaacaguaaggggcgccaaacgaauggcaguacuaggcgacaccgccugggacuucgggucagucggaggggcacuaaacagucucgggaaaggcauacaccaaauuuucggagccgccuucaaaagccuauucggaggaaugucgugguucucacaaauccuuauaggcacgcuacuaauguggcuugggcuaaauaccaaaaacggcagcaucagccugaugugccuagcacucggaggcgugcucauauuccucagcaccgccgucagcgcggacgucggaugcagcguggacuucagcaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9391 - RNA, 2356 nt, Artificial Sequence
  ZIKV prME variant mRNA Design 3 opt
gggagaaagcuuaccaugaacgcgcgaaaagaaaagaaaaggcgaggggccgacacaagcguuggaaucgucggccuacucuugacaacggcaauggcagcagaaguaacacggcgcggaucagcguacuacauguaccucgacagaaacgacgccggcgaagccaucagcuuccccacgacccucggcaugaacaaaugcuauauacaaaucauggaccucggccacaugugcgacgcaacaaugagcuacgaauguccaaugcucgacgaaggggucgaaccagacgacguagacuguuggugcaacacaacgagcacauggguaguauacggaacaugccaccacaagaaaggcgaagccagacgcagccgaagggcaguaacacuccccagccacucaacacgcaaacuccaaacccgaucacaaacguggcuagaaucccgugaauacaccaaacaccuuauacgcgucgaaaacuggaucuuccgcaauccaggguucgcacucgccgcagcagccaucgcguggcugcuaggauccagcacaucgcaaaaaguaaucuaccuaguaaugauccuccuaauugccccggcguacucaauccgaugcauaggagucucaaaccgggacuucguagaaggcaugagcggaggcacauggguagacauuguccuagaacacggcgggugugucaccgucauggcccaagacaagccaaccguggacaucgaacucgucacaacaaccguaucuaacauggcagagguaagaucauacugcuacgaagccaguauauccgacauggcaagcgauuccagaugcccaacccaaggcgaagccuaccuagauaaacaaucagacacccaauacguaugcaaacgcaccuuagucgaccgaggcuggggcaauggaugcggccucuucgggaaaggaagccuagucacuugugcgaaauucgccugcagcaagaagaugacaggcaaauccauccagcccgaaaaccucgaauaccgaaucaugcuaagcguacacggcagccaacacucuggaaugauagucaacgacacugggcacgaaacagacgaaaaccgcgcgaaaguggaaaucaccccaaacucacccagagccgaagccacacuaggaggcuucgguucacucggacucgacugcgaaccaagaaccggccuugacuucucagaccuauauuaucuaacaaugaacaacaagcacuggcuggugcacaaagaaugguuccacgacauaccucucccguggcacgcaggcgcagacacaggaacaccacacuggaacaacaaagaagcccuagucgaguucaaagacgcacacgccaaacgacagacuguagucgugcuaggaagccaagaaggagccgugcacacugcccucgcaggggcacuagaagcagaaauggacggagccaaaggaagacuaagcagcggacaccugaaaugcagacuaaaaauggacaaacuaaggcucaaaggagucaguuacucacuaugcacagccgcguucacauucacaaaaauacccgcagaaacgcuccacggaacagucacaguugaaguccaauacgcaggcacagacggccccugcaaagugcccgcccaaauggcaguagacaugcaaacacucacgcccguagggagacuaauaacggcaaacccggucauaaccgaaagcaccgaaaacagcaaaaugaugcucgaacucgauccgccguucggcgauagcuacaucgucauaggagucggcgaaaagaaaaucacacaccacuggcacagauccggauccacaaucggaaaagccuucgaagccacagugcgaggagccaaacguauggcgguacucggcgacacggccugggacuucggcagcgucgggggagcacugaacagccuaggaaagggaauccaccaaaucuucggagccgccuuuaaaagucucuucgggggcaugucaugguucagucaaauacucaucggaacacuacucauguggcuaggccuaaacaccaaaaacggauccauaucacuaaugugccuugcccuaggcggaguccuaauauuccucucaacagcagucagcgccgacgucgggugcucggucgacuucucaaaaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9392 - RNA, 2353 nt, Artificial Sequence
  ZIKV prME variant mRNA Design 3 opt
gggagaaagcuuaccauggccagaaaagagaaaaagagacgaggagcggacacguccgucggcaucgucggucuccuucugacaaccgccauggccgcggagguaacccgccgcggaagcgccuacuauauguaccucgacagaaacgacgccggagaagcaaucucauuccccacaacccuaggaaugaacaaaugcuacauccaaaucauggaccucggccacaugugcgacgccacaaugagcuacgagugccccaugcuagacgaaggaguagagcccgacgacgucgacugcuggugcaacaccaccucaaccuggguagucuacggaacaugccaccacaagaaaggcgaggcaagacgcucccgccgagccguuacgcuuccgucacacagcaccagaaaacuccaaaccagaucccagaccuggcucgaauccagagaauacacuaaacaccuuauacgagucgagaacuggaucuucaggaacccaggcuucgcguuagcagcagccgcgaucgccuggcuacucggcaguuccaccagccaaaaaguaauuuaccucgugaugauccuacuaaucgcaccggcauauucuauaagaugcauaggcgucagcaacagggacuucguggaaggaaugucaggaggcaccugggucgauaucguacuagaacacggaggcugcgucaccgucauggcccaagacaaaccaacggucgacaucgaauuagucaccacaaccguaagcaacauggcagaagucagaagcuacugcuacgaagcauccaucuccgacauggcaagcgacucacgcugccccacccaaggcgaagcauaccucgauaaacaaagcgacacacaauacguaugcaaaaggacacucguggacagaggaugggggaacggcugcggccuauucggcaaaggaagccucgugaccugcgccaaauucgcaugcuccaagaaaaugaccggaaaaucaauccaaccagaaaaucucgaauacagaaucaugcucuccguccacgggucccaacacagcggcaugauaguuaacgacacaggccaugagaccgacgaaaaccgggcuaaaguagagauaacccccaacucaccccgggccgaagccacgcuagggggcuucggaagccuaggacucgacugugaaccgcguacgggacucgacuucuccgaccuguauuaucucacaaugaacaacaaacacuggcuaguacacaaagagugguuccacgacauaccgcuaccauggcacgccggcgccgacaccggaacaccacacuggaauaacaaagaagcccucguagaguucaaagacgcgcacgcaaaaagacaaaccgugguagucuuaggcucacaggaaggggcaguacacacagcccuggcaggagcacuagaagccgaaauggauggagcaaaagggcgacuaagcagcgggcaccuuaaaugccgacucaaaauggacaaacuacgccucaaaggagucuccuacucgcuauguaccgccgcauuuacauucaccaaaauccccgcagaaacccuccacggaacaguaacaguagaaguccaauaugccggcacagauggcccaugcaaaguaccugcgcaaauggcagucgacaugcaaacacuaacgccugucggccgacuaaucacagccaacccaguaaucacagaaucgaccgaaaacagcaagaugaugcuagaacuagacccacccuucggcgacuccuacauagucauagggguaggagaaaagaaaaucacucaccacuggcacaggagcggcuccaccauaggaaaagcguucgaagcuaccgucagaggcgcaaaacgcauggcgguacugggagacaccgcaugggacuucggaagcgucggaggggcccuaaacucccuaggaaaaggaauccaccaaauauucggagccgccuucaaaagccuauucggaggcaugagcugguuuucccaaauacuaaucggcacccuccucaugugguuaggacuaaacaccaaaaacggcagcauaucacucaugugccucgcgcuaggcggcguccucauauuccucagcacagcagugucggccgacgucggcugcagcguagacuuuucaaaaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9393 - RNA, 2350 nt, Artificial Sequence
  ZIKV prME variant mRNA Design 3 opt
gggagaaagcuuaccaugagaaaagagaagaaacgaagaggagcagacaccagcguaggaauagucggacuccuccuaacuaccgcaauggcagcagaagucacgcgaagaggcagcgcguacuacauguaccuagaccggaacgaugccggcgaggccaucucauucccaacaacacucgggaugaacaaaugcuacauacagaucauggaccucgggcacaugugcgacgccacuauguccuacgagugcccgaugcuggacgaaggcgucgagccagacgacgucgacuguugguguaacacuaccagcaccuggguaguauacggaacaugccaccacaagaaaggagaagcccgcaggagcagacgcgcggucacgcugccaucccacagcacgcgcaaacuccaaacuaggucacaaaccuggcuagagagccgagaauacaccaagcaccuaaucagagucgaaaacuggauauuccgcaacccaggauuugcacuagcggccgccgcaauagcguggcuacuaggcucgagcacaucccaaaaagugaucuaccuagucaugauacuccuaaucgcacccgcauacagcauccgaugcauaggagucucuaacagagauuucgucgaaggaaugucgggcggaacgugggucgacauaguacuagaacacggaggcugcguaaccgugauggcccaagacaaaccaaccgucgacaucgagcuagucacgacuaccguaagcaacauggcagaaguacgauccuacugcuacgaagcaagcaucucagacauggccagcgacagccgaugccccacccagggcgaagcauaccuagacaaacaaucagacacacaauacgucugcaaaagaacacucguagaucgcggauggggcaacggaugcggacucuucggaaaaggcagucuagucacaugcgccaaauucgcaugcucaaagaaaaugaccgguaaauccauacaaccagaaaaccucgaauaccggauaaugcucucaguacaugggagccaacacagcggcaugauagucaacgacacagggcacgaaacugacgaaaaccgcgccaaaguagaaauaacaccaaacagcccccgcgccgaagccacacugggaggcuuuggaagccucggcuuagauugcgagccacgaacaggccuagacuucucggaccuauacuaccucacgaugaacaacaaacacuggcuaguacauaaagaaugguuccaugacaucccccucccauggcacgcuggcgcggacacggggacaccacacuggaacaacaaggaagcccugguagaguucaaggacgcccacgcgaaaaggcaaacagucgugguauuaggcagccaggaaggcgccguccacaccgcauuagccggcgcccuggaagccgaaauggacggagcaaaaggcagauuaagcuccggacaccucaaaugccggcuaaagauggacaaacucagauugaaaggaguauccuacagccuuugcaccgcagccuucaccuucacgaaaauaccagccgaaacacuacacggaacaguaacggucgaagugcaauacgcaggaacagacggccccugcaaaguaccagcgcaaauggcagucgacaugcaaacccugacgccggucggcagacuaaucaccgcaaacccagucaucacagaauccaccgaaaacucaaaaaugaugcuagaacuggacccacccuucggagacuccuacauuguaauaggagucggcgaaaagaaaauaacccaccacuggcaccgaucaggcagcacaauaggcaaagcauucgaagccaccguaagaggcgcaaaacgcauggcaguacugggagacaccgcaugggacuucggcagcguuggcggagcccucaacuccuuaggcaaaggaauccaccaaauauucggagcagcauucaaaagccuguuuggcgguaugagcugguucucccaaauacucaucgggacacugcugauguggcucggacucaacacgaaaaacgguagcauaagucugaugugccucgcccuaggcggcguacucaucuuccuaaguacagcgguaucagcagacguaggcugcagcgucgacuucagcaaaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9394 - RNA, 2347 nt, Artificial Sequence
  ZIKV prME variant mRNA Design 3 opt
gggagaaagcuuaccaugaaagaaaagaaacgccgaggcgcagacaccaguguaggcauaguaggacuucuccuaacaacagccauggcggcggaaguaacucgcagaggcuccgccuacuacauguaucucgaccgaaacgacgcgggugaagcaaucagcuucccaaccacucucggcaugaacaaaugcuacauccaaaucauggaccucggccacaugugcgacgccacaaugagcuaugaaugccccaugcuagacgaaggcguagaacccgacgacguagacugcugguguaacaccaccucaaccugggucgucuacggaacgugccaccauaagaaaggagaagcacgccgcagcagacgcgcggucacauuaccaagccauagcacgcgcaaacuacaaacccggucacagacauggcucgagagccgagaguacaccaaacaccuaauacgcgucgaaaacuggauauuccgaaaccccggauucgcacuugcagcggccgccaucgcauggcuccugggcucaagcaccagccaaaaaguaaucuaccuagucaugauccugcuaaucgccccagccuacagcaucaggugcauaggcgugagcaaccgagacuucgucgaaggaaugucgggcggaaccuggguagacaucguacuggaacauggcggcugcgucaccguaauggcccaagacaagcccaccgucgacauagaacucgucacaacuaccgucuccaacauggccgagguacgcuccuacugcuacgaagccucaaucuccgacauggccagcgacucacgaugcccuacgcaaggcgaagccuaccuggacaaacaaucggacacacaauacgugugcaaacgaacauuagucgaccgaggaugggggaacggcugcggccuguucggcaaaggcucauuagugaccugcgcaaaguuugccugcagcaaaaagaugaccggaaaauccauacaaccagaaaaccuagaauacagaaucaugcugucaguacauggcucacaacacagugguaugaucgucaacgacacgggccacgaaacagacgaaaaccgagcgaaaguagaaaucaccccaaacagcccgcgcgcugaagccacacucggagguuucggcucacuaggccuagacugcgagccacgaacuggccuugacuucuccgaccuguacuaccucaccaugaauaacaaacacuggcuaguacacaaagaaugguuccacgacaucccacuacccuggcacgccggcgccgacaccgggaccccacacuggaacaacaaagaagcacugguagaguucaaagacgcccacgccaaaagacaaaccgucguaguacuaggcagccaagaaggugcgguccacaccgcccuagccggcgcccuagaagccgaaauggacggugccaaaggccgccuuagcuccggucaccuaaaaugccgacuaaaaauggacaaacugagacuaaaaggcgucucauacucauuaugcacagcagccuuuacuuucacaaagaucccagccgagacgcuacacggaacaguaacaguagaaguacaguacgccgggaccgacggccccugcaaaguccccgcccaaauggccguagacaugcagacacuaaccccagucgggagacugaucaccgccaacccgguaauaacagaaagcaccgaaaacuccaaaaugaugcuugagcuagacccaccuuucggggauagcuacaucgucaucgggguaggcgagaagaaaauaacacaucacuggcauagaagcggcagcacgauaggaaaagcauucgaagcaacaguccgcggcgcaaaacgcauggccguuuugggcgacacagcaugggacuucggcuccgugggcggcgcacucaacuccuuaggcaaaggcauccaccagaucuucggggccgccuucaaaucacuauucggcggcaugucaugguucagccagauccucauaggcacacuccuaauguggcugggacuaaauaccaaaaacggcuccaucucacucaugugccuugcccucggaggcguccuaaucuuccuuaguacagccguaagcgccgacgucggaugcuccguagacuucuccaaaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9395 - RNA, 2344 nt, Artificial Sequence
  ZIKV prME variant mRNA Design 3 opt
gggagaaagcuuaccauggaaaagaaaagacgcggcgccgacacgagcgucgguauaguaggacuucuacucacgaccgccauggcggccgaaguaaccagacggggcagcgccuacuacauguaucucgaccgcaacgacgccggcgaagccaucucguuccccaccacacuagggaugaacaaauguuacauccaaauaauggaccucgggcacaugugcgacgcgacaaugaguuacgaaugcccaauguuagacgaaggcguagaaccggacgacgucgauugcugguguaacaccacaucaaccuggguagucuacgggaccugccaccacaaaaagggcgaagcccgaagaucacggagagccguuacccuaccgagccacuccacaagaaaauuacaaacacgaagccagaccugguuagaaucaagagaguacacaaaacaccugauaagaguagagaacuggaucuuccgaaacccgggcuucgcacuagccgccgccgcaaucgccuggcuccuaggauccucaaccagccaaaaagucauuuaccucguaaugauccuccucauagcaccagcauacuccauccgaugcaucgguguuuccaacagagacuucguagaaggcaugucgggcggcaccugggucgacaucguccuagagcacggaggcugcgugacugucauggcacaagacaagcccaccgucgacaucgagcuaguaaccacaacaguauccaacauggcugaaguccgaagcuacugcuacgaagcaucaaucucugacauggccagcgacagccgaugccccacacaaggagaagccuaccuagacaaacaaagcgacacccaauacgucugcaagcgcacccuagucgaccgcggauggggaaacgggugcggacucuucgggaagggaagccuaguaacaugcgccaaauucgcgugcucaaagaaaaugacgggcaagaguauccagcccgaaaacuuagaauacagaaucaugcucucgguucacggaucccaacacagcggcaugauaguaaacgacaccggccacgaaacagacgaaaacagggcaaaaguagaaaucacccccaacucacccagagccgaagccacgcucggcggcuucgggucacucgggcucgacugcgagccccgaaccggacuugacuucagcgaccuuuacuaccuaacaaugaacaacaagcacugguuagugcacaaagagugguuccacgauaucccacuccccuggcacgcaggcgcagacaccgguacaccccacuggaacaacaaagaagcacucguagaguucaaagaugcccacgcaaaaaggcaaaccgucguaguauuaggcagccaagaaggcgcaguacacaccgcccucgccggagcccuagaagcagaaauggacggcgcaaaaggaagacucuccucaggccaccucaaaugccgauugaagauggacaaacuucgacucaagggagucaguuacucauuaugcacugcagccuucaccuucaccaaaaucccggcagaaacgcuacacggaaccguaaccgucgaaguccaauaugcaggcaccgacggcccgugcaaaguacccgcccagauggcggucgacaugcaaacgcugacaccgguaggucgccucauaaccgccaaccccguuauaacggaauccaccgaaaacuccaaaaugaugcucgaacuagacccgcccuucggagacagcuacaucgugaucggugucggagaaaagaaaauaacccaccacuggcacagaagugggagcacaaucggaaaagccuucgaagccaccgucagaggcgccaaacgcauggccguccucggcgacacagcaugggacuucgggagcgucggcggugcccuaaacagccucggcaaaggcauacaccaaauauucggagcagcuuucaagagcuuauucgggggcaugagcugguucucccaaauccuaaucgggacccuacucauguggcucggacuaaacaccaaaaacggaagcauuagccucaugugccuggcccucgggggcguacucaucuuccugucgaccgccguaagcgcugaugucggaugcuccguagacuucucaaaaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9396 - RNA, 2341 nt, Artificial Sequence
  ZIKV prME variant mRNA Design 3 opt
gggagaaagcuuaccaugaagaaacgacggggcgcagacacauccgucggcaucguaggacuccugcuaaccacagcaauggcagccgaagucacacgcaggggcucugcauacuauauguaccuagaccggaacgacgcaggagaagccauaucguucccaaccacacugggaaugaacaaaugcuauauacagauuauggaccucggccacaugugcgacgccaccaugagcuacgaaugcccuaugcucgacgagggcguggaaccagacgacgucgacugcuggugcaacacgacaagcaccuggguggucuacggaaccugccaccacaagaaaggcgaggcgagacgcucccgacgcgcggucacccucccaagccacucaacgcgcaaacuacagacaagaucccaaacauggcucgaaagccgcgaauacaccaaacaccuaauccgagucgaaaacuggaucuuccgcaaccccggauucgcacuagccgccgccgcaauagcauggcucuuaggcucaagcaccagccaaaaaguaaucuaccucguaaugauccuucucaucgcaccagccuauucaauaagaugcauaggaguuagcaacagagacuucguagaaggaaugucgggaggaaccugggucgacaucguccucgagcacgggggcugcgucaccgucauggcucaggacaaaccaacagucgauaucgagcuagucaccacgacaguaagcaacauggcagaaguacgguccuacugcuacgaagcaucgaucuccgacauggcaucagacucacgaugcccaacccaaggcgaagcauaccuagacaagcaaucagacacgcaguacguaugcaagcgaacacugguagacagaggcuggggcaacggaugcggccuauucggaaagggcucacugguaaccugugcaaaauucgcaugcucaaagaaaaugacaggaaaaagcauacaacccgaaaaccucgaguaccguauaaugcucucaguccacggaagccaacauuccggcaugaucguaaacgacacaggacacgagaccgacgaaaacagagccaaagucgaaaucacgcccaauagcccacgcgccgaagccacccuaggaggcuucggaucacuaggauuggacugcgaaccacguaccggccuagacuucucagaccuauacuaccuaaccaugaauaacaaacacugguuagugcacaaagagugguuccacgacauaccacucccauggcacgcgggcgcggacacaggcacaccccacuggaacaacaaagaagcccuaguagaguucaaagacgcacacgcaaaacggcaaaccguaguaguccugggcagccaagaaggcgccguacacaccgcgcuggccggagcccucgaagcagaaauggacggcgcgaaaggaagacuauccuccggccaccuaaaaugccgacucaaaauggacaagcuaaggcugaaaggcgucagcuacucccucuguaccgcagcguuuaccuucaccaaaaucccagcagaaacccuccacggaacagugacaguagaaguccaauacgccggcacagauggcccuugcaagguaccagcgcaaauggcggucgacaugcaaacacuaacaccggucggccgccucauaacagccaaucccguaaucacagaaagcaccgaaaacagcaaaaugaugcucgaacuagacccgccauucggcgacagcuacaucgugauaggagucggcgaaaagaaaauaacacaucauuggcacagaagcggcuccacaaucggcaaagcauucgaagcaacaguaagaggcgccaaacgaauggcaguccugggugacacagcgugggauuucgggucagucggaggugcccuuaacagccuaggaaaagggauccaccaaauauucggggccgcauucaaaucacuuuucgggggaauguccugguucucccaaauccucaucggaacacuccuaauguggcucggacucaacaccaaaaacggcagcaucagccucaugugccucgcacucggaggcguacuaauauuccugucaacggcaguuagcgcagacguagggugcucagucgacuucagcaaaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9397 - RNA, 2338 nt, Artificial Sequence
  ZIKV prME variant mRNA Design 3 opt
gggagaaagcuuaccaugaagaggagaggggcggacaccagcgucggcauagucggccuacuacucacgaccgcaauggccgccgaaguaacacguagaggaucggccuacuacauguaccucgacaggaacgacgccggagaagccaucucauuccccacaacacugggaaugaacaaauguuacauccaaaucauggacuuaggacacaugugcgacgccaccaugucauacgaaugccccaugcucgacgaaggcguggaacccgacgacgucgacugcugguguaacacaacaucaaccuggguagucuacggcacaugccaccacaagaaaggcgaagcccgucgcagcagaagggcaguaacccucccaagccacucaacgcggaaacugcaaacccgaagucaaaccuggcuggaaucgagggaauacacaaaacaccuaauccgaguagaaaacuggaucuuccgcaauccaggcuucgcacucgccgcagcagccauagccuggcuacucggcagcuccacaagccaaaaaguaauuuaccucgucaugauacuacugaucgcccccgccuacuccaucagaugcaucggcgucucaaaccgcgauuucgucgaaggcaugucagguggcaccuggguagacaucguccucgaacacggaggcugcgucaccgucauggcacaagacaaacccacagucgacaucgaauuggucacaaccaccgucagcaacauggccgaaguacgaagcuacugcuacgaagcgucaauauccgacauggcgagcgacucccgauguccaacucaaggagaagcguaucucgacaagcaaucggacacccaauacguauguaaacgaacccuaguagaccgcggauggggcaacggaugcggccuauucggaaaaggcucccucgugacaugugcaaaguuugccugcagcaagaaaaugacaggcaaaagcauccaaccagaaaaccuagaauaccgaaucauguugucaguacacggcucccaacacaguggaaugauagugaacgacacaggccacgaaacagacgagaaucgcgccaaagucgagauaaccccuaacucaccacgcgcagaagcgacacugggaggauucgggucccuaggccucgacugcgaaccacgcaccggcuuagacuucagcgaucucuacuaccuaaccaugaacaacaaacacuggcucguacacaaagaaugguuccacgauaucccacuccccuggcacgccggcgcugacacaggcacgccccacuggaacaacaaagaagcgcuuguggaguucaaggacgcccacgcaaaaaggcaaaccgucguaguacuaggcucacaagagggcgccguacacaccgcccuggcaggcgcacucgaagccgaaauggacggcgccaaaggacggcucuccagcggacaccucaagugccgccuaaaaauggacaaacugagacuaaaaggcguaucauacagccugugcaccgccgcauucaccuucaccaaaauacccgcggaaacccuacacggcacaguaaccguagaaguacaauacgcaggcaccgacggccccugcaaaguaccggcccagauggccguagacaugcaaacccucacucccgucggacgccucaucacagcaaaccccgucauaacagaauccaccgaaaacagcaaaaugaugcucgaacucgacccacccuucggagacuccuacauaguaaucggagucggcgagaagaaaaucacccaccacuggcaucgaucaggaucaacgaucggcaaagcauucgaagcaaccgugcggggagcaaaaaggauggccguacucggcgacaccgccugggacuucgggucagucgggggcgcccuaaacucccugggaaaaggcauucaccaaaucuucggugccgccuucaaaagccuguucgggggcaugagcugguucagccaaauacucauaggcacacuccugauguggcuaggccucaacaccaagaacggcagcaucaguuuaaugugccuagcccugggaggaguccucaucuuccucagcacagccguaucagcagacguaggcuguagcgucgacuucagcaaaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9398 - RNA, 2335 nt, Artificial Sequence
  ZIKV prME variant mRNA Design 3 opt
gggagaaagcuuaccaugcgccggggcgcagacacaucagugggcaucguaggccuccugcucaccaccgcgauggccgcagaggucacccgacgcgggagcgccuacuacauguaccuagaccgaaacgaugccggcgaagccaucucguucccgacaacccugggcaugaauaaaugcuacauccaaauaauggaccuaggucacaugugcgacgcaacuaugucuuacgaaugcccgaugcucgacgaggguguggaaccugaugacguagacugcuggugcaacaccacaagcacaugggugguauacggaacaugccaccacaagaaaggcgaagcacgacggagccggcgcgcagucacccuaccgagccacucaacccgaaaacuccaaacccgcagccaaacaugguuggaaagccgcgaauacacaaaacaccuaauccgcgucgaaaacuggaucuuccgcaacccgggcuucgcccucgcagccgcagccaucgccuggcuuuuaggcucauccaccucacaaaaaguaaucuaccuagucaugauccuacucauagccccugcauacuccaucaggugcauaggcguauccaacagggacuucgucgaaggcaugagcggcggcaccugggucgacaucguacucgaacacgggggcugcguaacagucauggcacaagacaaacccacagucgacaucgaacucgugacaaccacagucagcaacauggcagaaguaagaucauacugcuacgaagcauccauaagcgacauggcaucugacagcagaugcccaacacagggagaagcauaccucgacaaacaaagcgacacacaauacgucuguaaacgaacccuaguagaccgcggauggggaaacggcugcggacucuucggaaaaggcagccucguaacaugcgccaaauucgccugcagcaagaaaaugaccggcaaauccauacaacccgaaaaccucgaguacagaaucaugcuuucaguccacggaagccaacauuccggcaugauagucaacgacaccggacacgaaaccgacgaaaacagagcgaaagucgaaaucacacccaacucacccagggcggaagcaacacugggaggauucgggucacucggucuugauugugaaccccgaacuggacucgacuucuccgaccucuacuaccucaccaugaacaacaaacacuggcuaguccacaaagagugguuccacgacaucccacuacccuggcacgcaggagccgacacaggcaccccacacuggaacaacaaagaagcacuggucgaguucaaagacgcacacgccaaacgccaaacugucgucguacuaggcagccaggaaggagcaguccacacagcacuggccggagcucuagaagcagagauggacggcgcgaaaggacgccuaagcucaggccacuuaaaaugccgacucaaaauggacaaacuccgucuuaaaggagucucguacucacugugcaccgcugcauucaccuuuaccaagauccccgcggaaacccuacacggaaccgucacaguagaaguccaauacgccggaacugacggcccaugcaaaguccccgcccaaauggcaguggauaugcaaacccuaacccccguaggacgccuaauaacagccaaccccguuaucaccgaauccaccgaaaacucuaaaaugaugcuggaacuagauccacccuucggagacuccuauauaguaaucggcgucggagaaaagaaaaucacgcaccacuggcaccggagcggcucaaccaucggaaaagccuuugaggcgaccguccgcggagccaaacgcauggcaguacucggagacacagccugggacuucgggagcgucggaggcgcccuaaacucacucggcaaaggcauccaccaaaucuucggagccgcauucaaaucccucuucggcggcaugagcugguucucacagauacuaauaggaacccuccuaauguggcucggccucaacaccaaaaacgguagcaucagccuaaugugccuagcacuaggcggcguacuaauauuccucuccaccgccgucagcgccgacgugggcuguuccgucgacuucuccaaaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9399 - RNA, 2332 nt, Artificial Sequence
  ZIKV prME variant mRNA Design 3 opt
gggagaaagcuuaccaugagaggcgccgauacuagcguaggaaucgugggacuccuacucacaacugcaauggccgcagaagucacaagacgaggaagcgcauacuacauguaucuagaccggaacgacgccggagaagcaaucagcuucccgacaacacuaggaaugaauaaaugcuauauccaaauaauggaccuaggccacaugugcgacgcgaccaugagcuacgagugccccaugcucgaugaaggcgucgaaccagacgacgucgacugcuggugcaacacuacaagcacauggguaguauacgggacaugucaccacaagaaaggagaagccagacgcucgcgccgcgcagucacacuccccucacacucaacacggaaacuacaaacgcgcucgcaaaccugguuggaaucccgagaauacaccaaacaccuaauccgcgucgaaaacuggaucuuccgcaacccggguuucgcacucgcagccgcagccaucgccuggcuacucggcagcucaacaagccaaaaagucauauaccuaguaaugauacuacugaucgcaccagccuacagcaucagaugcaucggcgucucaaaccgcgacuucgucgaaggaauguccggcggaaccuggguagacaucguacuagaacacggcggaugcgucaccgucauggcacaagacaaacccacaguagacauugagcucguaacaacaacagucuccaacauggccgagguccgaucauacugcuacgaagcauccaucagcgacauggccagcgacuccaggugcccgacccaaggcgaagccuaucucgacaaacagagcgacacgcaguacgucugcaaacgaacauuagucgaccgaggcuggggaaacggaugcggccuauucggaaaaggaagccuagucacgugcgcaaaauucgcaugcucaaagaaaaugaccggaaaaucgauccaacccgaaaaccuggaauaccgaauaaugcucuccguacacgggagccagcacucaggaaugauagucaaugacaccggccacgaaacagacgagaaucgagcuaaaguagagauaacacccaacagccccagagcagaagcgacccucggcggcuucggcucccucggcuuagacugcgaaccacgcaccggccucgacuucagcgaccuauacuauuuaacaaugaacaacaaacacuggcuagugcacaaagaaugguuccacgacauaccacuaccauggcacgcaggggcagacacggggaccccacacuggaacaacaaagaagcccuaguagaguucaaagacgcacacgcaaaacgacaaacaguagucguacuugggagccaggaaggcgcaguccacaccgcacuagccggggcccucgaagcagaaauggacggggcaaaaggcagacuaagcagcggacaucugaaaugcagacucaaaauggacaaacuccgccuaaaaggcguguccuacucacuaugcaccgcagccuucaccuucacgaaaaucccagcggaaaccuuacacggcaccgucacaguggaaguacaauacgccggcaccgacggaccaugcaaaguaccagcacagauggccgucgauaugcaaacacugacgcccgucggacgacugaucacugcaaacccgguaaucaccgaaagcacagaaaacucaaaaaugaugcucgagcucgacccucccuucggagacagcuacaucgucaucggagucggagaaaagaaaauaacucaucacuggcaccgcagcggaucaaccaucggcaaagccuucgaagcuacagucagaggcgcaaagagaauggcgguacuaggcgacacagcaugggacuucggaucagugggaggcgcacugaacagccucggaaaggggauacaccaaaucuucggcgccgcauucaaaagccucuucggcggcaugagcugguuuucccagauacuaaucggaacgcuccuaauguggcuagggcuaaacaccaaaaacggcagcauaagccugaugugccucgcgcucggaggcguccucaucuuccuaucaaccgcagucucggcagauguaggcugcucagucgacuucagcaaaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9400 - RNA, 2329 nt, Artificial Sequence
  ZIKV prME variant mRNA Design 3 opt
gggagaaagcuuaccaugggggccgacacuuccguaggcaucgucggacuacuccugaccacggccauggccgccgaaguaacccgccgcggcagcgcauacuacauguaccucgaccgcaacgacgccggggaagcuauaucguucccaacaacccucggaaugaacaaaugcuacauacaaaucauggaccucggccacaugugcgacgcaaccaugagcuacgaauguccaaugcuggacgaagggguagaaccagacgacguggacugcuggugcaacaccacaagcaccugggucgucuacggaaccugccaccacaagaaaggagaggcccgacgaagucgccgcgcagucacccucccaagccacucuacacgaaaacuucaaacccggucacaaacauggcucgaaucaagagaauacaccaaacaccucauccgagucgaaaacuggaucuucagaaaccccggauucgcccucgcagcggccgccauagcguggcuacuaggcucaagcaccucacaaaaagucaucuaccuggucaugauccuccuaauagcacccgccuacagcauccgcugcaucggcgucucaaacagagacuucguagaaggaaugagcggaggaacauggguagacauagugcucgaacauggaggcugcguaaccgucauggcccaagacaaaccaaccgucgacauagaacuggucacuacaaccguaucuaacauggccgagguaagaucauacugcuacgaagccuccaucuccgacauggccagugacagccgaugcccaacgcaaggcgaagccuaucucgacaaacaauccgacacccaauaugucugcaagcgcacacucguagaccgcggcuggggaaacggcugcggccucuucggcaaaggcagccuaguaaccugcgcaaaauucgcaugcuccaagaaaaugacaggaaaauccauccaacccgaaaaccucgaauaccgcaucaugcucuccgugcacggcagccaacacuccggaaugaucguaaacgacaccggacacgaaacagacgaaaaccgcgccaaagucgaaauaacaccaaacuccccacgcgcggaagccacacuaggcggcuucggcucccuaggccucgacugcgaacccagaacaggacucgacuucagcgaccucuauuaccuaaccaugaacaacaaacauugguuaguacacaaggaaugguuucacgacaucccccuccccuggcacgcaggcgcagauacaggaacaccacacuggaacaacaaagaagcccucguagaauuuaaagacgcccacgcuaaacggcaaacaguaguaguccuaggcagccaagagggggccguacacaccgcacucgcaggcgcccucgaagcugaaauggauggcgccaaaggcaggcucucaucgggucaccucaaaugccgacuaaaaauggacaaacuacgucuaaaaggggucucuuacucacucuguacggcggccuucaccuucaccaaaauaccagcagagacacuacacggaaccgucacagucgagguccaauacgccggcacagacggaccaugcaaagucccugcacaaauggccgucgacaugcaaacccucacaccaguaggacgccucaucacggccaaccccgucaucacagaaagcaccgaaaacuccaaaaugaugcucgaacuagaucccccguucggagacagcuacaucguaauaggcgucggagagaagaaaauaacacaccacuggcaccgauccggauccacaauaggcaaagccuucgaagcaaccgucagaggcgcaaaacgaauggccguacugggagacacagccugggacuucggaagcgugggcggagcacucaacagccuuggcaaaggaauccaccaaaucuucggcgcagcauucaaaucacucuucggaggcauguccugguucucacaaauacugauagggacacuccugaugugguuaggucucaacaccaaaaacggcagcauuucucucaugugccucgcccucggaggaguacucaucuuccucuccacagcggucagcgcagacgucggaugcuccgucgacuuuucgaaaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9401 - RNA, 2326 nt, Artificial Sequence
  ZIKV prME variant mRNA Design 3 opt
gggagaaagcuuaccauggccgacaccagcgucggaaucgucgggcuccuauugaccaccgccauggccgccgaagucacccgccgcggaagcgccuacuacauguaccuagaccgaaacgacgcaggcgaagccaucagcuuccccacaacacuaggcaugaacaaaugcuacauucaaaucauggaccuaggccacaugugcgacgcaaccaugucauacgagugucccaugcuagacgaaggaguagaaccagacgauguagacugcuggugcaacaccaccuccacaugggucgucuacggaaccugccaccacaaaaagggcgaggcacgacgaucacgccgcgccgucacucuaccaucacacucaacucgaaaacuacaaacccgcucccaaacaugguuagaaagccgcgaguauacgaaacaccuaauccgaguagaaaauuggauauuccggaacccaggcuucgcacuggcagccgccgcaaucgcauggcuucugggauccucaacgucacaaaaagucaucuaccucgucaugauacugcucauagcaccagcauauuccauccgcuguaucgggguauccaacagggacuucguugaaggcaugucaggagggacaugggucgacaucguccucgaacacggaggcugcgucacagucauggcacaagacaaacccaccguagacaucgagcucgucaccacaacagucagcaacauggccgaaguccgcagcuacugcuacgaagcaucaaucagcgauauggccagcgacucaaggugcccuacucaaggcgaggcuuaccuagauaaacaaagcgacacccaauacgucugcaaacgcacccuaguagaccgaggauggggaaacggaugcggccucuucggcaaaggcucccucgugacaugcgcaaaauucgcaugcagcaagaaaaugacaggcaaaagcauacaaccagaaaaccucgaauacagaaucaugcugagcguccacgggucacaacacucaggcaugauagugaacgacaccggccacgaaaccgacgaaaaccgcgcaaaaguagaaauaaccccaaacagcccacgagccgaagccacccuaggcggcuuuggaagccucggccuagacugcgagccccgcaccggucuagacuucagcgaccucuacuaccugaccaugaacaacaaacauuggcucgugcacaaagagugguuccacgacauaccccuaccuuggcacgcaggagcagacaccggcacaccccacuggaacaacaaggaggcacugguagaguucaaggacgcccacgcaaaacgacaaacaguagucgugcuaggaucucaagaaggcgccguccacacagccuuagccggggcacucgaagcagagauggacggagccaaaggacgacuauccuccggccaucucaaaugccgccucaaaauggacaagcuccgacuaaaaggcguaagcuacagccuuugcacggcagcauucacguucacgaaaauucccgccgaaacacuccacggcacaguaaccgucgaaguacaauacgccggcacagaugggcccugcaagguccccgcccaaauggcaguugacaugcaaacccucacccccguaggccggcugaucaccgccaacccagucaucaccgaauccaccgagaacagcaaaaugaugcucgaacucgaucccccuuucggagacuccuacauagucaucggaguaggagaaaagaaaaucacccaccacuggcaccgcagcggcuccaccauaggaaaagcauucgaagcuaccguccgcggggccaaacgcauggccguacucggcgacacggcgugggacuucggcucgguuggaggagcccuaaauagccucggcaaaggaauccaccaaauauucggagcggcuuucaaaucccuuuucgguggcaugucaugguuuagccaaauucucaucggaacacugcucauguggcugggcuuaaacaccaaaaauggaucaaucucgcucaugugccuagcacuaggagggguccuaauauuccugucaaccgcagugagcgccgacguaggcugcagcgucgacuucucaaaaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9402 - RNA, 2323 nt, Artificial Sequence
  ZIKV prME variant mRNA Design 3 opt
gggagaaagcuuaccauggacacaucaguuggcaucgucgggcugcuacucaccacggccauggccgcagaagugacaagaagaggaagcgcauacuacauguaucuggaucgcaacgacgccggcgaagcgaucagcuucccaacgacccucggaaugaacaaaugcuacauacagaucauggaccuaggacacaugugcgacgcgaccauguccuacgagugcccaaugcuagacgaaggcgucgagccagacgacgucgacugcugguguaauacgaccucaaccuggguagucuacgguacaugccaccacaagaaaggcgaagcacgaagaucaagacgagccgucacccuacccucacacagcacuagaaaacuccaaacccgaagucaaacauggcuagaaagucgagaauacacgaaacaccugauccgcguagaaaacuggauauuccgaaacccaggcuucgcgcucgccgcagccgccauagccuggcuccucggcagcagcaccagucagaaggucauauaucucgugaugauccuccucaucgccccugccuacucaauaagaugcaucggcguaagcaaccgggacuucguggaaggaaugucuggaggcaccuggguagacauaguccucgaacacggaggcugcguaacuguaauggcccaagacaaaccuacagucgacauugaacuggucaccaccaccguauccaacauggccgaagugcgcagcuacugcuacgaagccagcaucucagacauggcgagugacagccgaugccccacucaaggcgaagccuaccuagacaaacaaagcgacacacaauacgucugcaaacgaacacucgucgaucguggaugggguaacggaugcggccucuucggcaaagguucccuagucacuugcgcaaaauucgccugcagcaaaaagaugacaggaaagagcauacaacccgaaaaccuagaauaccgcaucaugcugagcguccacggcagccagcacagcggaaugauaguaaacgacacaggacacgaaaccgacgaaaauagggcgaaagucgaaaucacccccaacagccccagagcggaagcaacacuagguggcuucgggagccucggauuagacugcgagccccgaacaggccucgacuucagcgaccuauacuaccuaacaaugaacaacaaacacugguuaguccacaaagagugguuccaugacaucccccucccauggcacgccggcgccgacaccggcacaccccacuggaacaacaaggaggccuuagucgaguucaaagacgcccacgcaaaacgacaaacagugguaguccuaggaagccaggaaggagccguccacacggcccucgcaggagcacucgaggccgaaauggacggcgcaaaaggccgccugagcucaggacaccucaaaugccgccuaaaaauggacaaacuaagacucaaaggaguaagcuacucccuuugcacagcagccuucacauucacgaagaucccagcagaaacacugcauggcacagugacaguagaaguacaauacgccggcaccgacggaccaugcaaagugcccgcccagauggccguagauaugcagacucuaacucccguaggcagacuaaucaccgcaaaccccgucaucaccgagagcacagaaaacagcaaaaugaugcuagagcucgaucccccauucggagacaguuacauaguaaucggaguaggcgagaagaaaaucacccaccacuggcaccgcaguggauccacuauaggcaaagccuuugaagcaacaguccgcggcgcaaaaaggauggcaguccuaggagacaccgcaugggauuucggcagcguaggcggagcacuaaacagccucggcaaaggcauacaccaaauauucggagccgccuucaagagccuauucggcggcauguccugguucagccaaauacuaaucggcacccuccucauguggcucggacugaacaccaaaaacgggucaaucagccucaugugccuggcacugggagggguacucauauuccuaagcaccgcaguaucagccgacguagguugcagcguagacuuuagcaaaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9403 - RNA, 2320 nt, Artificial Sequence
  ZIKV prME variant mRNA Design 3 opt
gggagaaagcuuaccaugaccucagucggcauaguaggacugcuccugacaacagcgauggccgccgagguaacucgaagaggaagcgcguacuacauguaccucgaccgaaacgacgcgggcgaagcaaucagcuucccgaccacccuaggcaugaacaaaugcuacauccaaauaauggaucugggacacaugugcgacgcaaccaugucauacgaaugucccaugcucgacgaaggaguagaacccgacgacguggauugcuggugcaacacaaccagcaccuggguagucuauggaacaugccaccacaagaaaggcgaagcccgacgauccagacgugccgucacgcuacccagccacagcacacgcaaacuccaaaccagaagccaaacauggcucgaaagccgagaauacaccaaacaccucauaagagucgaaaacuggauauuccgcaaccccggguucgcacuagcugcagcagccaucgcauggcuccuaggcuccagcacaagccaaaaagucauauaccuugucaugauccuacucauagcaccggccuacuccauacgcugcauaggcgucuccaaccgagacuucgucgaaggaaugagcggaggcaccuggguagauaucguccuggagcacggcggaugcguaaccgucauggcgcaagacaagccaaccguagacaucgagcucguaaccaccacgguuagcaacauggccgaaguccgcuccuacugcuacgaagcaagcauaagcgacauggcaagugacagcagaugccccacucaaggcgaagcguaccucgacaaacaaagcgacacacaauacguaugcaaacgaacccucguagacagaggcuggggcaacggcugcggccuauucggaaagggcucccucguaaccugcgcgaaguucgccugcucaaagaaaaugacaggcaaaucgauacaaccggaaaaccucgaauacagaauaaugcuguccguccacggaucacaacacagcggaaugauagugaaugacacaggacaugaaaccgacgagaaccgagcaaaagucgaaauaacaccaaacuccccacgggccgaagccacccucggagguuuuggcagcuuaggccucgacugcgagccacgaacgggccucgacuucucagaccucuacuaccuaacgaugaacaacaaacacuggcuuguccauaaagaaugguuccacgacauaccccuccccuggcacgccggagccgacaccggcacaccccacuggaacaacaaagaggcgcuaguagaguucaaagacgcccacgccaagagacaaaccgugguaguacuagggagccaagaaggcgcgguacacacagcacuagccggagcccucgaagccgaaauggauggagcaaaagggcgacucagcuccggccaccucaaaugccgccuaaaaauggacaaacuaagacugaagggcguaagcuacagccuaugcacagccgcauucaccuucaccaaaauacccgccgaaacccuacacggaacagucaccgucgaaguccaauacgccgguaccgacggaccgugcaagguaccggcacaaauggcaguagacaugcaaacucuaacccccguaggcagacucaucacggccaaccccguaauaaccgaaucuacagaaaacaguaagaugaugcucgaacucgacccacccuuuggcgacuccuacaucgucauaggagucggagaaaagaaaaucacccaccacuggcacaggaguggcagcacaaucgguaaagccuucgaagccacaguacgcggggcaaaacgcauggcgguccucggcgacacagcaugggacuucgggagcguaggcggcgcgcuaaacagccucggcaaaggcauccaccagaucuucggcgcggcauucaaaucacuauuuggagggaugagcugguucucucaaauccucauaggaaccuugcugauguggcugggccuaaacacgaaaaacgggagcaucagccucaugugccuugcccuagguggcguccuaaucuuccuuagcacagccgucucagccgacgucggaugcagcguggacuucaguaaaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9404 - RNA, 2320 nt, Artificial Sequence
  ZIKV prME variant mRNA Design 3 opt
gggagaaagcuuaccaugaccagcgucgguauaguaggccuacuacuaacaacggccauggcagccgccgugacacgcagaggaucugccuacuacauguaccuagaccgcaacgacgccggcgaagcgaucuccuucccuacuacccugggcaugaacaaaugcuacauccaaaucauggaccuaggacacaugugcgaugccacaaugucauacgaaugcccuaugcuggacgagggagucgaacccgacgacguagauuguuggugcaacaccacaagcacauggguaguauauggaacaugccaccacaaaaagggcgaagcgcgcagaagccgccgcgccgucacccuacccagccacuccacaagaaaacugcaaacgagaagccaaaccuggcucgaaucccgcgaauacaccaaacaccucauccgcgucgaaaacuggaucuuccgaaaccccggcuucgcgcuagccgcggccgcuaucgcguggcuccugggaucaaguaccagccaaaaaguaaucuaccuaguaaugauccuccucaucgcaccagccuacuccauccgaugcauuggcguaagcaacagagacuucgucgagggcaugaguggcggcaccuggguagacaucgugcuagaacacggaggcugcgucaccguaauggcccaagacaaacccacagucgacauagaacucguaacaacaacgguuucaaacauggcagaggugagaucguauugcuacgaagccagcaucagcgauauggccagcgacagccgcugcccgacacaaggagaagcguaccuggacaaacaaagcgacacccaauacgucugcaagcgaacacucguagaccgcggguggggcaacggcugcggacuauucggaaaaggaagccuuguaaccugcgcaaaguucgccugcagcaagaaaaugacaggcaaaagcauccaaccagaaaaccucgaauaccggaucaugcucagcguccauggcucacaacacagcggcaugauagucaacgacacgggccacgaaacagacgaaaaccgagcaaaaguagaaauaacccccaacuccccaagagcggaagccacccuaggcggauucggaucccucggacucgacugcgaaccacgaaccggacucgacuucucagaccucuacuaccucaccaugaacaacaaacacuggcucguccacaaagaaugguuccacgacauaccacucccauggcacgccggcgccgacacaggcacaccacacuggaacaacaaagaggcccuugucgaguucaaagacgcacacgcaaaacgccaaaccgucguaguccucggaucccaagaaggagcgguccacaccgcccucgcaggcgcccuagaagccgaaauggacggagcgaaaggacgccuaucaucggggcaccucaagugcagacucaaaauggacaaacuccgacuaaaaggcgucagcuacucacucugcaccgccgcauucacguucaccaaaauccccgccgaaacccuacacggaacagugacaguagaagugcaguacgcaggaacagacggaccaugcaaaguccccgcccagauggcaguagacaugcaaacacucacaccagugggacgccuaaucaccgccaaccccguaaucacagaaagcaccgaaaacagcaaaaugaugcuagaacucgacccacccuucggggacuccuacaucguaauaggagucggggaaaagaaaaucacgcaccacuggcaccgaagcgguuccacaaucggcaaagccuucgaagcaacaguacgcggcgcaaaacggauggcgguccucggagacaccgcaugggacuucggaagcgucggaggcgcccuaaacagucuaggcaaaggaauacaccaaauauucggugcggccuucaaaagucuauucggcggcaugagcugguucagccaaauccucauaggaacacucuuaauguggcucggccuaaauacuaaaaacggcucaauuagccuaaugugcuuagcacuaggaggcgugcucaucuuccugucaaccgccgucuccgccgacguaggcugcagcguagacuuuagcaaaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9405 - RNA, 2332 nt, Artificial Sequence
  ZIKV prME variant mRNA Design 3 opt
gggagaaagcuuaccaugcgaggcgcagacacgagcguaggcaucgucggccugcuuuuaaccacagcaauggcugcagccguaacccgacgaggaagcgcauauuacauguaccuagacagaaaugacgcaggagaagcaauaucguuccccacaacacuaggaaugaauaagugcuacauccaaaucauggaccucggacacaugugcgacgccacgaugucguacgaaugccccaugcuagacgaaggagucgaaccagacgacguggauugcugguguaacacaaccucaaccugggugguauacggcacgugccaccacaagaaaggcgaagcaagacgaucaagacgagcaguaacucuccccucccacagcaccagaaaacuccagacaagaucccaaacauggcuagaaucacgagaauacacaaaacaccugauaagagucgaaaacuggauauucagaaaccccggauucgcacucgccgcagcagccauagcauggcucuuaggcagcucaacaagccaaaaaguaaucuaccuagucaugauccuacuaaucgcgcccgcguacucgauccgcugcaucggcguaucgaacagagacuucgucgaaggcauguccggagggacgugggucgacauagugcuagaacacggcggaugcgucacagucauggcacaagacaaaccgacggucgacauagagcuaguaaccaccacaguaagcaacauggcagaagucagaaguuacugcuacgaagcauccauaucagauauggcaucagacuccagaugcccgacccagggagaggccuaccuagacaaacaaucagauacccaauacgucugcaaacgaacccugguagaccgcggcuggggaaacggcugcggccuguucggcaaggggagcuuaguaaccugcgcaaaauucgcaugcagcaagaaaaugaccggaaaaagcauccaacccgaaaaccucgaauaucgcauaaugcucagcguccacggcagccaacacagcggaaugauagucaacgacacaggccacgaaacagacgaaaacagggcaaaagucgaaaucacaccaaauagcccaagggccgaagcaacacucgggggcuucgggucacuuggccuagacugcgaacccagaacgggacuagacuucagcgaccuguacuaccucaccaugaacaacaaacacuggcuaguacacaaagaaugguuccacgacauaccccucccauggcacgcaggagccgacaccgggacgccacacuggaacaacaaggaagcacucgucgaguucaaagacgcccacgcaaagcgccaaacaguagucguacugggcucccaagaaggggcaguacacacggcacucgcaggcgcacucgaagcagaaauggacggcgccaaaggccgccucucaagcggacaccucaaaugccgccucaagauggacaagcuccgacucaaaggcguaagcuacagccuuugcacagcagcauucacauucacaaaaauacccgcagaaacacuccacggcacagucacagucgaagugcaauacgcaggaaccgacggcccaugcaagguaccagcacaaauggcagucgacaugcaaacgcuaaccccagucggccgccucauaaccgcaaacccaguaauaacugagagcacagaaaacagcaagaugaugcucgagcucgacccacccuucggcgauagcuacauagugauaggagucggcgagaaaaagaucacgcaccauuggcacagaagcggaagcacaauaggaaaagcguucgaagcaacagucagaggcgcaaaacgcauggccguccucggcgacacagcaugggacuucggcucaguaggaggggcacucaauagccuaggcaaaggaauacaccagauauucggagcggcauucaaaagccuguucggcgguaugagcugguucagccagauacuaauuggaacccuacuaauguggcuaggccuaaacaccaaaaacggaagcaucagccuaaugugccuagcacuuggcggaguacucauauuccucagcacagcagucuccgccgacguaggaugcagcgucgacuucagcaaaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9406 - RNA, 2356 nt, Artificial Sequence
  ZIKV prME variant mRNA Design 3 opt
gggagaaagcuuaccaugcgagggcucucaucacgcaaacgccgcagucacgacguccuaaccguccaauuucuaauccuaggaaugcuccuaaugaccggaggggucacccgcagaggcucggccuacuacauguaccucgacaggaacgacgccggcgaagcaauuagcuuccccacaacccuugguaugaacaaaugcuacauacaaauaauggaccuaggacauaugugcgacgcaacgauguccuacgagugucccauguuggacgaaggcguagaaccagacgacguggacugcuggugcaacaccacaagcacauggguuguauacggcacaugccaccacaagaaaggagaagcccgccgaucacgacgugccgucacccugcccagccacagcacgcgcaaacuacaaacucgcucgcaaaccuggcuggaaagccgcgaauacacaaaacaccucauccgagucgagaacuggauauuccgcaaccccggcuucgcacucgcggcagccgcaauagcauggcuucuagggucaagcaccagccaaaaagucaucuaccucguaaugauccuccugaucgcccccgccuacuccaucagaugcaucggaguaucaaacagagauuucguagaaggcaugucagguggaaccuggguagacaucguacuagagcacggaggcugcgucaccgucauggcacaggauaaacccacagucgacaucgaacuggucacgaccacugucucaaacauggccgaagugcguagcuacuguuacgaagccagcaucagcgacauggcgagcgacagucgaugccccacccaaggggaagcauaccucgacaaacaaagcgacacacaauacguaugcaagcgaacacucguagaccgcggcugggggaacggaugcggacucuucggaaaaggcagccuagugaccugcgccaaauucgcuuguucaaagaaaaugaccggcaaaagcauacaaccggaaaaccucgaauacagaauaaugcucuccgugcacggaucucagcacagcggcaugauagucaacgacaccggccacgagaccgacgaaaacagggcgaaagucgaaauaacaccgaacagcccccgagccgaggcgacacucggcggcuucgggucccucggccuagauugcgaaccccgcacaggccucgacuucagcgaccucuauuaucuaacaaugaacaacaaacacuggcuaguccacaaagaaugguuccacgacauuccacuccccuggcacgcgggagcggacacgggaacaccacacuggaacaacaaagaagcacucguagaguucaaagacgcacacgccaaacgacaaaccguaguaguacuaggaagccaagaaggcgccgugcacacagcacuagcaggggcccuagaagccgaaauggacggcgccaaaggccgacuaagcaguggacaccuaaaaugccgccuaaaaauggacaaacuacgccuaaaaggagucagcuauagccuaugcacagccgcauucacguucacaaaaauucccgcggaaacgcuacacggaacuguaaccgucgaaguacaauacgccggcaccgacggaccgugcaaggucccugcacaaauggcuguagacaugcaaacacucacaccggucggccgucuaauaacagccaaccccguaaucaccgaauccaccgaaaacucaaaaaugaugcuggaacucgacccacccuucggagacaguuacauagucaucggagucggagagaaaaagaucacucaccacuggcacagaucaggcucaacgaucggaaaagccuucgaagcaacaguccgcggggcaaaaagaauggccguccuaggagacacagccugggauuucgguagcguaggaggagcccucaacucccuaggaaagggcauacaccaaauauucggagccgccuucaaaagccucuucggaggcaugucgugguucucgcaaauacuaaucggcacccuccugauguggcuagggcuaaacaccaaaaacggaucgaucucucucaugugccuagcccucgguggcgugcuaauauuccucuccaccgccgucagcgcggauguaggaugcagcguagacuucagcaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9407 - RNA, 2356 nt, Artificial Sequence
  ZIKV prME variant mRNA Design 3 opt
gggagaaagcuuaccaugcgcggacucagcucccgcaaacgacgcucacacgacguacuaaccgugcaauuccucauccuugggaugcuacucaugacaggcgcggugacccgacgcggcagcgcauacuacauguaccucgaccgaaacgacgcgggcgaagcaaucagcuuccccacaacacucggcaugaacaaaugcuacauacaaauaauggaccucggacacaugugcgacgccaccaugucguacgagugcccaaugcuagacgaaggcguagaacccgacgacgucgacugcuggugcaauaccaccucaacauggguagucuacggcacaugccaccacaagaaaggagaagcccgccgcucuagacgcgccgucacucuccccagucacucaacccgaaaacuccaaacgcgcucccaaacauggcucgagucccgcgaauacacaaaacaccucauccgaguagaaaacuggaucuuccgaaaccccggauucgcacucgccgcagcagccauagcauggcuccugggaucaagcacaucccagaaaguaaucuaccucgucaugauccuacuaaucgcucccgcguacagcauacgaugcauaggcgucagcaacagagacuucguagaaggaaugucgggcggcacauggguagacaucgugcucgagcacggcggaugcguaaccguaauggcccaagacaaacccacaguagacaucgagcucguaacuaccacagucaguaacauggccgaaguccgcagcuacuguuacgaggccucaauuucagacauggccuccgacagucgcugcccaacacaaggcgaagcguaccuggacaaacaauccgacacccaauacguaugcaaacgcacccucguugacaggggguggggaaauggaugcggauuauucgguaaagggucccuaguaaccugcgccaaauucgcaugcucaaagaaaaugaccggcaaaucaauacaaccagagaaccuagaauaccgcauaaugcucagcguccacgggagccaacauuccggaaugaucguaaacgacaccggacacgaaaccgaugagaaucgcgcaaaaguagaaaucacaccaaacuccccacgggcugaggcgacacuaggcggcuucggcagccuaggccuagacugcgaaccccgcaccgggcucgacuucucggaccuguacuaccucacgaugaacaacaaacacuggcucguacacaaagaaugguuccacgauaucccccucccauggcacgccggcgccgacaccggaacaccccacuggaacaacaaagaagcccucguagaguucaaagacgcccacgccaaaagacaaacagugguuguacuagggucacaggaaggcgccguacacacagcacucgccggagcccucgaagccgaaauggacggggcaaaagguagacuaaguagcggccaccucaagugccgacucaaaauggacaagcugcgacugaaaggggucaguuacucccuaugcaccgcugcauucaccuucaccaagaucccggccgaaacccuacacggaacagucaccgucgaagugcaguacgccggcacagacggccccugcaaaguacccgcgcaaauggccgucgacaugcaaacacucacgcccgucggacggcucaucacagccaaccccguaaucacggaaagcacagagaacagcaaaaugaugcuagaacuagacccacccuucggagacuccuacauaguaaucggcguaggcgagaagaaaauuacacaccacuggcacagguccggcucaacgauugguaaagccuucgaagcaacaguccgcggugccaagcgcauggcaguccuaggcgacacagcaugggacuucggcucagucggcggcgcacucaacagucugggaaagggcauacaucagauauucggcgcagccuucaagucgcuauucggagggaugagcugguucagccagauccucaucggaacacugcucauguggcuaggacuaaacaccaaaaacgguagcaucagccucaugugccuagcacuaggcggaguccuaauauuccuuagcacggcagucagcgccgacgugggcugcagugucgacuucucuaaaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9408 - RNA, 2347 nt, Artificial Sequence
  ZIKV prME variant mRNA Design 3 opt
gggagaaagcuuaccaugcgcaucaucaacgcgcgcaaagaaaagaaacgacgcggagccgacaccucggucggaauagucggccuccuacugacaaccgccauggcagccgaggucacccgacgaggcuccgccuacuacauguaccucgaccgcaacgacgccggagaggccauuuccuuccccaccacccucggcaugaacaaaugcuacauccaaauuauggaccuaggacacaugugcgacgcaacaaugagcuacgaaugcccaaugcuagacgaagguguagaacccgacgacguagacugcuggugcaacacaacauccacaugggucguguacgguacaugccaucacaagaaaggcgaagcacgccgcagccgacgcgccguaacccucccaucccacagcacaaggaaacuucaaacacgcagccagacguggcucgaaagcagagaauacacaaaacaccucauacgaguagaaaacuggauauuucgcaacccgggcuuugcccucgccgccgcggccauagcauggcuauuaggcagcaguacgucccaaaaaguaauuuaccuagucaugauacuacuaauagcaccagccuacuccauaaggugcaucggagugucaaaccgcgacuucgucgaaggaaugagcggaggaacaugggucgacaucguccucgaacacggcgguugcgucacagucauggcccaagacaaacccacaguagacaucgaacucgucacgacaacaguauccaauauggccgaaguacgauccuacugcuacgaggcaagcauaucagacauggccuccgacucaagaugcccaacccaaggagaagccuaccucgacaaacaguccgacacucaauacgugugcaaacggacacuugucgaccgcggguggggcaacggauguggccuauucggcaaaggcagucugguaaccugcgcaaaauuugcaugcuccaagaaaaugacagggaaauccauacaacccgaaaaccucgaauacagaaucaugcucucaguccacgggucacagcacagcggcaugauaguaaacgacaccggccacgagacagacgaaaaccgcgccaaaguagaaauaaccccaaacagcccccgggccgaggccacccugggcggguucggcagccucggucucgacugcgaaccccgaacaggucuagauuucucagaccuauacuaccuaaccaugaacaacaaacauuggcucguacauaaagagugguuccacgacaucccacucccauggcacgcaggcgcggacaccgguaccccacacuggaacaacaaagaagcgcuagucgaguucaaagacgcacacgcaaaaagacaaacagucguaguccuaggcucccaggaaggagccguccacacggcacucgccggagcacucgaggcagagauggacggcgccaaaggccgccucagcucaggacaccuaaaaugccgccucaaaauggacaaacucagacucaaagggguaucauacagccuaugcacagccgcauuuacguucaccaaaauaccagccgagacacuccacggcaccguaacagucgagguccaauacgcaggaacagacggccccugcaaagucccagcccaaauggccgucgacaugcaaacacucacacccgugggccgucuaauaaccgcaaaccccguuauaacagaauccacagaaaacuccaaaaugaugcuggaacucgaucccccauucggggacagcuacaucguaaucggcguaggcgaaaagaaaaucacccaccacuggcaccgcuccggaagcacaauaggcaaagcauucgaagcaaccguccgcggagcgaaaagaauggcuguacucggagacaccgcgugggacuucggcagcgugggcggcgcacucaacucccuaggaaaaggcauccaccagauauucggcgcagccuucaaaucccuuuucggcggcauguccugguucucccaaauccuuauaggaacccuucuaauguggcucggccucaacaccaaaaacggcuccauaucccucaugugccucgcccucggcggcguacuaaucuuccuaagcacagccgucagcgccgacgucggaugcugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9409 - RNA, 2344 nt, Artificial Sequence
  ZIKV prME variant mRNA Design 3 opt
gggagaaagcuuaccaugaucaucaacgcccgaaaagaaaagaaacgacgaggcgccgacacaagcguaggcaucguaggacuccugcucacuacagccauggcagcagaagugacccgccgcggauccgccuacuacauguaccucgaccgcaacgacgccggagaggcaauaucauuccccaccacgcuaggaaugaacaaaugcuacauacaaauaauggaucucggacacaugugcgacgccaccaugagcuacgaauguccaaugcuagacgagggaguugaacccgaugacguagacugcuggugcaacaccacaucgaccugggucgucuacgguaccugccaccacaagaaaggcgaagcccgacgcucacgccgagccgucacucuacccagccacuccacaagaaaacuccaaacacgcagccaaacauggcuagaaucccgcgaauacacaaaacaccuaauacgaguagagaacuggaucuucagaaaccccggcuucgcgcucgcagcggccgccaucgcauggcucuuaggcuccagcaccagccagaaaguuaucuaccucguaaugauccuccucaucgccccagccuacuccauccgaugcauuggaguaagcaacagggacuucguagaaggaaugagcggcggaacaugggucgacauaguacucgaacacggaggcugcguaaccguaauggcacaagacaaacccaccguggacauagaacucgucacaaccaccguuuccaacauggccgaagugagaagcuacuguuacgaagccagcaucucagacauggcuuccgauagcagaugccccacccaaggagaggcauaccucgauaaacaaucagacacccaauacgucugcaaaagaacacucguagaccgcgguuggggcaacggcugcggacucuuuggcaaaggaucccuaguuaccugcgcaaaauucgccugcagcaaaaagaugacgggcaagucaauacagcccgaaaaucuggaauaccggaucaugcuaucgguccacggcagccaacacagcggcaugaucgugaacgacaccggccacgaaaccgacgaaaacagagcaaaagucgagauaaccccaaacucaccccgagcagaagccacccuaggcggauucggcagccugggccuagacugcgaacccagaaccggccuagacuucuccgaccuguacuaccucacaaugaacaacaaacauugguuaguacacaaagaaugguuccacgacauaccucuaccauggcacgccggcgcagacaccgggaccccgcacuggaacaacaaggaagcacugguagaguucaaggacgcacacgcaaaacgccaaacggucgucgugcucggcagccaagaaggagccguccacaccgcgcuagcaggagcucucgaggcggaaauggacggcgccaaaggcaggcucuccucagggcaccucaaaugccgccucaaaauggacaaacuccgacucaaagguguguccuacucucucugcacagcagccuucacauucaccaagaucccugccgaaacacuccacgggacagucacgguagaaguccaauacgccgguacagacggaccgugcaaagucccagcccaaauggccguagacaugcagacacuuaccccagucggccgccucaucaccgccaaccccgucaucacagaaagcaccgaaaacucaaaaaugaugcuggaacucgacccacccuucggugacagcuacaucguaaucggaguaggagagaagaaaauaacacaccacuggcaucgcagcggcuccaccaucggcaaagcauucgaggcuacaguaagaggagccaaacgaauggccguccuaggagacaccgcaugggacuucgggagcgucggcggcgcacuaaacagccucggaaaagggauacaucaaaucuucggcgccgccuuuaaaucauuauucggcggcaugagcugguucagccaaauauuaaucggaacgcuacucauguggcuagggcucaacaccaaaaacggauccaucucacuaaugugccuggcucucggaggcguccucaucuuccuuucaacagcaguaagcgccgacguaggcugcugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9410 - RNA, 2341 nt, Artificial Sequence
  ZIKV prME variant mRNA Design 3 opt
gggagaaagcuuaccaugaucaacgcccgcaaagagaagaaacgcagaggcgccgacacgagcguaggaaucgucggccuacuacucacuacagccauggcggccgaggucacacgcagagggucagccuacuacauguaucucgacaggaacgacgccggagaagcgaucucauuccccaccacccucggaaugaacaaaugcuacauccaaauaauggaccucgggcacaugugcgacgcuacaauguccuaugagugcccuaugcuagacgaaggcguggaaccugacgacguagauugcuggugcaacacaacuucaaccuggguaguauacggcacaugccaccacaagaaaggagaggcacgcaggagccggcgcgccgucacgcucccaucacacuccacgcgaaaacuucaaacccggagccaaacuuggcuagaaagcagagaauacaccaaacaccucauaagaguagaaaacuggaucuuccgaaaccccggauucgcgcucgcagccgcagccaucgccuggcuacucggcucgagcacaagccaaaaagugaucuaccuaguaaugauacuccuaaucgcccccgccuacucaauccgaugcaucggaguaucaaaccgagacuucguagaaggaaugucaggaggaacuugggucgauauaguacuagaacacggaggcugcgucacggucauggcccaagacaaaccaacuguugacaucgaauuaguaaccacgaccgucagcaauauggcagaggugcgauccuacugcuacgaagccuccaucucggacauggcaagcgacucacgaugcccaacccagggagaggcguaccucgacaaacaaagcgacacacaguacguaugcaaaaggacgcuagucgaccgcggaugggggaacggaugcgggcucuuuggaaaaggcucgcucguaacaugcgccaaauucgcgugcaguaaaaagaugacaggcaagagcauacaaccagaaaaccuagaauaccggaucaugcucuccguccacggcucccaacacagcggaaugauagucaacgacaccggacacgaaaccgacgagaacagagcaaaagucgaaauaacacccaacagcccccgcgccgaagcaacccuaggaggguucgggagccucggccuggacugcgaaccacgcaccggacuagacuucagcgaccuauacuaccuaacaaugaacaauaaacacuggcuaguccacaaagagugguuucacgacauaccccugccauggcacgcaggagcugacaccggaaccccacacuggaacaacaaagaagcccuggucgaguucaaggacgcccacgccaaaagacaaacaguagucguacucggcucacaagaaggcgcgguacacacagcacucgccggcgcgcucgaagccgagauggacggcgccaagggcagauuaagcagcggccaccucaagugcaggcuaaaaauggacaaacuacgacugaagggcguaucauacucacucugcacagcugcauucacauucaccaagauaccagcggaaacacuacacgggacaguaaccguagaaguacaauacgccggcaccgacggccccuguaaggucccggcccaaauggcagucgacaugcagacccuaaccccugucggaagacugaucaccgccaacccaguaaucacagaaucaacagagaacucaaaaaugaugcuggaacuggacccgcccuucggagauagcuacaucgugaucggcgucggugaaaagaaaaucacgcaccacuggcacagaagcgggagcaccauagguaaagccuucgaggcgacaguuaggggcgccaaacgaauggcaguccucggcgacacagcaugggacuucggcagcgugggcggagcacucaacucacuagggaaaggaauccaccaaauauucggcgcagcauuuaaaagccuauucggaggaaugagcugguucucacagauccuaauuggcacacuacuaauguggcuagggcucaacaccaaaaacggaagcaucagccuuaugugccucgcacucgguggaguccuaauuuuucugagcaccgccgucagugcagacgugggaugcugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9411 - RNA, 2338 nt, Artificial Sequence
  ZIKV prME variant mRNA Design 3 opt
gggagaaagcuuaccaugaacgcacgcaaagaaaagaagcgccgcggagccgacacauccguaggaaucguaggacuacuccucacaacggccauggcagccgaaguaaccagacgcggcuccgccuacuacauguaccucgaccgaaacgacgcaggagaggcuaucucauuccccacaacccucggaaugaacaaaugcuauauacagauaauggaccugggccacaugugcgacgcaacaaugagcuacgaaugcccaauguuagaugaaggcguagaacccgacgacgucgacugcugguguaacaccacaucaaccuggguaguauacggcacaugccaccacaagaaaggcgaagcgcgcagaagccgucgagcagucacacuaccaucacacucaacacgaaaacuucagacccgaucacaaaccuggcuagaaucacgagaauauacgaaacaccucauccgaguagaaaacuggaucuucagaaaccccggcuucgcccuugcagcggcggccaucgccuggcuccuagggaguucaaccagccagaagguaaucuaccucgucaugauccuccucaucgcaccagccuacagcauccgaugcaucggcgucagcaacagagacuucguagaaggaaugagcggaggcacauggguagacauaguacucgaacacggcgggugcguaaccgugauggcacaagauaaacccacagucgacaucgaacuugugaccaccaccguaagcaacauggcagaaguaagguccuauugcuacgaagcaucaauuucugacauggcauccgacagccgaugcccaacgcagggagaagccuaccuagacaaacaaagcgacacccaauacguaugcaaacgaacgcugguagaccgcggcuggggcaacgguugcggacuauucgggaaaggaagccuagucacaugcgccaaauucgccugcagcaaaaagaugacaggcaaaucaauccaacccgaaaacuuggaauacagaaucaugcuauccguccacggaagccaacacuccggcaugauagucaacgacacgggacacgaaacagacgaaaaccgugcaaaaguagaaaucaccccgaauagcccaagagcggaagccacacuagggggcuuuggcagccucggccuagauugcgaaccacgaacagggcuagauuucucggaccuauacuauuuaaccaugaacaacaaacacuggcuaguucacaaagaaugguuccacgacauaccgcucccguggcacgccggcgcagauacgggcaccccacacuggaacaacaaggaagcgcugguagaguucaaagaugcucacgccaaacgccaaaccgucguaguacuaggcucacaggaaggugcaguacacaccgcacuagccggagcacucgaagccgaaauggacggagcaaaaggacgacucagcagcggacaucuaaaaugucgacucaaaauggacaaacucaggcucaagggagucagcuacagccuaugcacggccgcauucacauucaccaaaauaccggcagaaacacuccacgguaccguaacaguagagguccaauacgccggcaccgacggccccugcaaaguaccagcacaaauggcaguagacaugcaaacccucacccccguaggacgacuaauaacggccaacccaguaauaacugaaagcaccgaaaacaguaagaugaugcuagaacuggacccaccauucggugacucauacaucgucaucggcguaggcgaaaagaaaauaacccaccacuggcaccgaagcgggucaaccauaggaaaagccuucgaagcgacagugcgcggagccaaacgcauggccguacugggcgacacagcaugggacuucggaucaguaggcggcgcccucaacagccucggcaaagggauccaccaaaucuucggagccgcguuuaaaucgcuauucggcggcauguccugguucucccaaauccucaucggcacccuacucauguggcuuggccuaaacaccaaaaauggcucaaucagccucaugugccuagcacucggaggcguccugaucuuccugucaacagcggucucggcagacgucggcuguugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9412 - RNA, 2335 nt, Artificial Sequence
  ZIKV prME variant mRNA Design 3 opt
gggagaaagcuuaccauggcacgcaaggaaaagaagcgccgcggagcagacaccucagucggaauagucggccugcuacucaccaccgccauggcggcggaaguaacccgccgggggucagccuauuacauguaccucgaccgcaacgacgcaggcgaagccaucucauuccccaccacgcuaggcaugaacaaaugcuacauccaaauaauggaccucggccacaugugcgacgccaccaugagcuacgaaugcccaaugcuagacgaaggcguagaacccgacgacgucgauugcuggugcaacacaacaucaacauggguugucuacggaaccugccaccauaagaaaggcgaagcacgacgcagccgcagagcaguuacacuacccucccacucgacaagaaaauuacaaacacgaucacaaaccuggcucgaaucacgagaauacaccaaacaccuaauccgcgucgaaaacuggauauuccgaaaucccggauucgcucuagcagcagccgcgaucgccuggcugcucggcuccuccacaucccaaaaagucauuuaccucgucaugauccuauuaaucgcaccggccuacucaauacgcugcauaggaguauccaacagagacuucgucgaagggaugucaggcggcaccuggguagacaucguacuagaacacggcggcugugucaccguaauggcccaagacaaaccaaccgucgacaucgaacucgucacgaccaccguaagcaacauggccgaaguacgcuccuauugcuacgaagcaagcauaucagauauggcaagcgacucccgcugcccaacacagggcgaagcauaccuggacaaacaaagugacacccaauacgucuguaagcggacccucgucgaccgcggauggggcaacggcugcggccucuucggaaaaggaucccuaguaacaugcgccaaauucgcaugcuccaagaaaaugaccggcaaguccauacaaccagaaaaccuagaauaccggaucaugcuaaguguacacggcagccaacauuccggaaugauagucaacgacacagggcacgaaaccgacgaaaaccgagcaaaaguagaaauaaccccaaacucccccagagcagaagccacacuaggcggcuuuggcucucuaggccucgacugcgaaccaagaacaggucuagacuucucagaccuuuacuaccuaacaaugaacaacaaacacuggcucguacacaaagaaugguuccacgacaucccauugccauggcacgcaggagcagacacaggaacaccccacuggaacaacaaagaagcgcuagucgaguucaaagacgcacacgccaagagacaaaccguaguaguccucggcucacaagaaggugccguccacaccgcacuagcaggcgcacuagaagccgaaauggacggagcaaaaggacgacuauccucaggacaccuaaaaugccgucucaaaauggauaaacuaagacugaaaggcguaucauacucacucugcacagcagccuucacguucaccaaaauccccgccgaaacacuacacggcacagucacaguagaaguacaauacgccggcaccgacggucccugcaagguaccagcucaaauggcggucgacaugcaaacccuaacccccguagguagacucaucacugcaaaccccgugaucaccgaaucaaccgaaaacucaaaaaugaugcuggaacuagacccaccguucggcgacagcuacauagucaucggaguaggggagaaaaagauaacccaccacuggcacagaaguggaucgaccaucggcaaagccuucgaagcaacaguucgaggcgccaaaagaauggcaguccucggagacaccgcgugggacuucggcuccguaggcggagcccucaacucccucggcaagggaauacaucagaucuucggcgccgccuucaagagccuuuucggaggaaugagcugguucucacaaauccuaauaggcacacuacucauguggcucggccucaacaccaaaaacggguccaucucccuuaugugccuggcacugggcggaguacucauuuuccucagcacugccgucagcgccgacgucggcuguugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9413 - RNA, 2332 nt, Artificial Sequence
  ZIKV prME variant mRNA Design 3 opt
gggagaaagcuuaccaugagaaaagaaaaaaaacgccgaggagcagacacaagcgucggcaucguaggauuacuacugacaaccgcgauggcagccgaagucacaagacgaggcucagcauacuacauguaccucgaccgcaacgacgcaggugaagcaauaagcuucccgacgacucuaggaaugaacaaaugcuauauucaaauaauggaccuaggacacaugugcgacgcaaccaugagcuacgaaugccccaugcuagacgagggugucgaacccgacgacguagacugcuggugcaacaccacaagcaccugggucgucuacggcacaugccaccacaaaaaaggagaggcacgcagaagcagaagagcagucacgcuccccucccacagcacaagaaaacuacaaaccagaucccaaaccuggcuggagucgagagaauacacaaaacaccucauaaggguagaaaacuggaucuucagaaacccgggauucgcccuagcggcagccgccaucgcauggcuccugggcucaaguacuagccagaaagugauauaccuaguaaugauacugcuaauagcacccgccuacucaauccgcugcaucggcgucucaaaccgagacuucgucgaagguaugagcggcgguacauggguagacaucguacuagaacauggcggaugcgucaccgucauggcacaggacaaacccacaguggacaucgaacuggucaccacaaccgucucuaacauggcagagguacgcuccuacugcuacgaagccucaaucucagacauggcgagcgacucccgcugucccacccagggcgaagccuaccuggacaaacaauccgauacacaauacgugugcaaacgcacacucguugaccgagggugggggaacgguugcggccucuucggcaaaggcagccuggugaccugcgcaaaauucgcgugcucgaaaaaaaugacaggcaagagcauacaaccagaaaaccuagaguaccggaucaugcuaucaguccacggaucgcaacacucaggaaugauagucaacgauacaggacaugaaaccgacgaaaaccgagcgaaaguagaaaucacacccaacagcccgcgcgccgaagcaacacuagggggcuucggaagccucggacuagacugcgaaccacgcaccggccuagacuucagcgaccuuuacuaccuaaccaugaacaacaaacacuggcuaguccacaaagaaugguuccaugacaucccgcuaccguggcacgcuggcgcagacacggggaccccacauuggaacaauaaagaagcacuagucgaauucaaagacgcgcacgcaaaacggcaaacagucgucguacuaggcagccaagagggagcuguccauaccgcgcuagccggagcccuagaagcagaaauggacggagcaaaaggccgccuuagcuccggccaccucaaaugucggcuuaagauggacaaacucagacucaagggcgucagcuacagccucugcaccgcagccuucacauucaccaaaaucccggccgaaacccuacacggaacaguaacaguagaggugcaauacgcgggaacagacgguccaugcaaagucccagcccaaauggcuguagacaugcaaacccuuaccccgguagggagacuaauaacagccaaccccguaauuacugaaucaacagaaaacagcaaaaugaugcucgaacucgacccacccuucggcgauagcuacauaguaaucggggucggagaaaaaaaaauaacacaccacuggcacagaucaggauccacaauaggaaaagcauucgaagccaccguuaggggagcaaaacgaauggcaguacucggcgacaccgccugggacuucggcagcguaggcggcgcccuaaacagccucggaaaaggaauccaccaaauauucggugcagcauucaaaagccucuucggcggcaugagcugguucagccaaauacucaucggcacgcuccuaauguggcuaggacuaaauacaaaaaacggcaguaucagccuaaugugccucgcgcuagggggcguccuaaucuuccucucaacagcagucagcgccgacgucggaugcugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9414 - RNA, 2329 nt, Artificial Sequence
  ZIKV prME variant mRNA Design 3 opt
gggagaaagcuuaccaugaaggaaaaaaaacgacgcggagcagacacaucagucggaaucguaggccuccuccugacaacagcaauggcugccgaaguaacgaggcggggaagcgcguacuacauguaccucgacagaaacgacgcaggcgaagccaucuccuucccaaccacauuaggaaugaauaaaugcuacauccaaauaauggaccucggacacaugugcgacgccacaaugucauacgaaugcccgaugcucgaugaaggcgucgaacccgaugacguagacugcuggugcaacacaacgagcacaugggucgucuacggaacaugccaccacaaaaaaggcgaggcccgacgaucacgccgagcagugacacuccccucccacagcacccgcaaauuacaaacgagaagccaaacauggcucgaaagccgcgaauauaccaaacaccugaucagaguggaaaacuggauauucaggaaccccggcuucgcccuggcagcagcagcaauagccuggcuacuuggcaguagcacaucccagaaagucaucuaccucgucaugauacuccucaucgcaccugcauacagcauccgaugcaucggcguguccaacagagacuucguagaaggcaugagcggcggaacaugggucgacauaguacucgaacacggcggcugcguaaccgugauggcucaagacaaacccacagucgacaucgagcuagucaccacgaccguaagcaacauggcagaaguacgcagcuacugcuaugaagccucgauauccgacauggcaucagacucccggugccccacccagggagaagcauaccucgacaaacaauccgacacccaguacguuuguaaacgcacacuagucgacagaggcuggggaaacggcugcggccuauuuggcaaaggcagccuggucacaugcgcaaaauucgccugcagcaaaaaaaugaccggaaaaagcauacaaccagaaaaccuggaauaccgcauaaugcuguccguccacggaagccaacacucaggcaugaucguaaacgacaccggccacgagaccgacgaaaacagagcaaaagucgaaaucacaccgaacagcccacgagccgaagcaacccucggaggguucggcucguuaggacucgacugcgaaccaagaaccggacucgacuucucagaccucuacuaccuaacaaugaacaacaaacacuggcucguccacaaagaaugguuccacgacauaccacucccauggcacgccggagccgacaccggcaccccacacuggaacaacaaagaagcccucgucgaauucaaagacgcccacgccaaacgacaaaccguaguaguccucggaagccaagaaggcgcuguacacacggcccucgcaggggcgcuggaagccgaaauggauggcgcaaaaggaagacuaagcuccggccaccuaaaaugccgucucaagauggacaaacugcgccucaaaggcgucucauauagccuaugcaccgccgcuuucacauucacaaaaauacccgccgaaacacuccacggcacaguaacagucgaaguacaauaugccggcacagacggcccaugcaaagucccagcccaaauggccgucgacaugcaaacccucacaccagucggccgccuaaucacagcaaaccccguaauaacagaaagcacagaaaacucaaaaaugaugcuagaacuggacccccccuucggcgauagcuacauagucaucggaguuggcgaaaaaaaaauaacacaccacuggcaccgcuccggcuccacgaucggcaaagcauucgaagcaacgguacgaggagcaaaaagaauggcaguacuaggagauacugcaugggacuucggcuccguggggggggcacuaaacucccuaggcaaaggcauccaccaaaucuucggcgcagccuucaaaucacucuucggcgggauguccugguucagccaaauccucaucggcacccuacuaauguggcuugggcuaaauacgaagaacggaagcauaucccucaugugccuagcacuaggcggcguccucaucuuccuuagcaccgcaguauccgcagacguaggcugcugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9415 - RNA, 2326 nt, Artificial Sequence
  ZIKV prME variant mRNA Design 3 opt
gggagaaagcuuaccauggaaaagaaaagacgaggagcagacaccagcgucggcaucgucggucuacuacucacaacagccauggccgcagaagugaccagacggggaucggcauacuacauguaccucgaccguaacgacgcaggagaagcaaucucauucccaaccacacucggcaugaacaaaugcuacauccaaauaauggacuuaggacacaugugcgacgccacgauguccuacgaaugcccgaugcuagaugaaggaguggaacccgacgacgucgacugcuggugcaacaccacgagcacguggguaguauacggaacaugucaccacaaaaagggugaagccagacgcucccgacgggcggucacccuucccucacacagcacaagaaaacugcaaacucgcagccaaacauggcuggaaucacgcgaauacacaaaacaccuuauacgggucgaaaacuggaucuuccgaaacccaggauucgcacuagcagcggccgccauagccuggcuacuaggcagcaguacuucacaaaaaguaauauaccuagucaugauacuccugauagcccccgcuuacuccauccgaugcaucggaguaagcaauagagauuucguugaaggaaugucaggaggaacauggguagacauaguccucgagcacggcggcugcguaaccgucauggcacaggacaaaccaaccguggacauagaacuggucacaacaacugucagcaacauggccgagguacgcaguuacugcuacgaggcauccaucuccgacauggcaucggacagccgaugcccgacccaaggagaggcauaccucgacaaacaaagcgacacgcaauauguauguaaacgaaccuuaguagaccgcggauggggcaacgguugcggacucuucggaaaaggcucccuggucacaugcgcaaaguucgccugcuccaagaaaaugacgggaaaaagcauccaaccggaaaaccuagaguaccgaaucaugcugucuguccacggaucccagcauuccggcaugaucgucaacgacacuggacacgaaacagacgaaaaccgagccaaaguggagauaaccccaaacagcccaagagcagaggcaacccuaggaggauucggaucccuaggacuggacugcgaaccgcgcacuggacucgacuucucagaccuauacuaccuuacaaugaacaacaaacacuggcucguccacaaagagugguuccacgauaucccccuacccuggcacgccggcgcagacacaggaacaccacacuggaacaacaaagaagcccuagucgaguucaaagacgcgcacgccaaacggcaaacaguagucguccucggaagccaagaaggggcuguacauaccgcacucgccggcgcccuagaagccgaaauggacggcgcgaaaggacgacuaagcucaggacaccucaaaugccggcucaaaauggacaaacucagacucaaaggaguuuccuacucccuaugcacagcagccuuuaccuucaccaaaauacccgcggaaacccuccacggaaccgucacagucgaaguccaauaugcgggaaccgacgggcccugcaaagugcccgcccaaauggccgucgauaugcaaacccucacccccguaggccgacuaaucacagccaaccccguaauaaccgagucaacagaaaacuccaaaaugaugcuagaacuagaucccccauucggagacagcuacauaguaaucggcguaggcgaaaagaaaaucacccaccacuggcaccgauccggaagcacaaucggaaaagccuucgaagcaaccguccguggcgccaaaagaauggccguacuuggagacacagcaugggacuucgggagcgucggaggagcacugaacagccucggaaaaggaauccaccaaaucuucggcgcagcguucaagagccuauucggcgggaugagcugguucucacaaauacuaaucggaacacugcucauguggcuaggccuaaacaccaaaaacggaucaaucagccucaugugucucgcgcugggaggaguacugaucuuccuaucaacagccguaagugccgacgucggcugcugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9416 - RNA, 2323 nt, Artificial Sequence
  ZIKV prME variant mRNA Design 3 opt
gggagaaagcuuaccaugaaaaaaagacggggugccgacaccucgguaggaauaguaggacuccuacucaccaccgccauggcagcagaaguaacacgccgaggcagcgccuacuauauguaccucgacagaaacgacgccggcgaagccaucuccuuccccaccacacucggcaugaacaaauguuacauccaaauaauggaucucggccacaugugcgacgcaaccaugucauacgagugcccaaugcucgacgaaggagucgaacccgaugacguagacugcuggugcaauaccaccuccacaugggucguauacggaacuugccaccauaaaaaaggagaagcaagacgaucacggagagccgucaccuuacccagccauuccacccggaaacuacaaaccagaagccaaacguggcucgagagccgggaauauacaaaacaccucauaagagucgaaaauuggauauucagaaaccccggauucgcccucgccgccgcagccauagccuggcuacucggauccagcacaagccagaaagucauauaccucgucaugauacugcuaauugccccagcuuauuccauccggugcauaggcgucaguaaccgggacuucguagaaggaaugucaggagggaccuggguagacaucgugcuagaacacggaggcugcguaaccgucauggcacaagacaaaccaacagucgacauagaacugguaaccacuacagucagcaacauggccgaaguacgaucauacugcuaugaagcaucaaucagcgacauggcaagcgacagucgaugccccacgcagggcgaagccuaccuagacaaacaaucagacacacaauacgugugcaaacggacacuugucgacagaggguggggaaacggcugcggccuauucgggaaaggcagccuaguaaccugcgcgaaauucgcgugcucaaaaaaaaugaccggcaaaagcauccagccagaaaaccuagaauacaggaucaugcucagcguccacggcagccagcacagcgguaugauagucaacgacacuggccacgaaacagacgagaaccgcgcaaaaguggaaaucacaccaaacucaccacgcgccgaagcaacccucgguggguucggcucccuuggacuagacugugaaccaagaaccggccucgacuucagcgaccuauacuaccucacaaugaacaacaaacacuggcucguccacaaagaaugguuccacgacauaccccuaccauggcacgcaggcgcagacacagggacuccacacuggaacaauaaggaagcgcuagucgaauucaaagacgcccacgcaaaaagacaaaccguggucguccugggaucccaagaaggagcagugcacaccgcccucgcaggcgcucucgaagccgagauggauggagcaaaaggaagacuaagcagcgggcaccucaaaugccgacuaaaaauggacaaacuaagacuaaaaggcgucagcuacagcuuauguacggccgccuucaccuucacgaaaaucccugccgaaacccuacacggcaccguaaccgucgaaguccaauacgccggaacagacgggccguguaaaguccccgcccagauggcaguagauaugcaaacacucacccccguaggacgccuaaucacggcaaaccccgucauaaccgaaagcacagaaaacucaaaaaugaugcucgaacuagauccccccuucggagacagcuacauaguaauaggaguaggagaaaaaaaaaucacccaccacuggcacagaucaggaaguaccaucggcaaggccuucgaagccaccgucagaggagccaaacgaauggcgguccucggagacaccgccugggacuucggaagcgucggcggcgcacucaacucacuaggcaaaggcauacaccaaaucuucggagccgccuucaaaagccucuucggcggaaugagcugguucucccaaauacuaaucggcacccuacucauguggcucggucucaacaccaaaaacggcuccauaucccucaugugccuagcacucggaggcguccucaucuuccugagcaccgccgucagugccgacguaggcuguugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9417 - RNA, 2320 nt, Artificial Sequence
  ZIKV prME variant mRNA Design 3 opt
gggagaaagcuuaccaugaagaggagaggcgcagauacgaguguagguauaguagggcucuugcucacgaccgcaauggcagccgaagucacaagaaggggcucggcauacuacauguaccuggacaggaacgacgccggcgaagcaauaucguucccaacaacgcuagggaugaauaaaugcuacauacagaucauggaucuagggcacaugugugacgccacaaugucauacgaaugcccgaugcuggaugaaggcguagagcccgacgacguggacugcuggugcaacacgacaagcacauggguagucuacggcacaugccaucacaagaaaggcgaagcgagaagaaguaggagagcaguaacacugccaagccacucaacccgcaagcuacaaacccgaagucagaccuggcuagaaucaagagaguacacaaaacaccugauaagaguagagaacuggauauuccgaaacccaggauucgccuuggcagccgcggcaauagccuggcuauuaggcucguccaccagccaaaaggucaucuaucucgugaugauacuacuaaucgcccccgcauacucaaucaggugcauaggagucagcaaccgcgacuuuguagaggggaugucgggcgggacauggguagacaucguacuagaacacgggggcugugucacagugauggcccaagacaaacccacgguagauaucgaacucgugaccacgacaguuagcaacauggcagaaguuagaucguacugcuacgaagccagcauaagcgacauggccucagacucgcgaugcccaacgcaaggggaggcauaccuggacaaacaaucagacacccaauacgucugcaaaagaacccuagucgaccgaggcuggggcaacgggugcgggcuauucggcaaaggcagccugguaacaugugcuaaauucgcaugcagcaaaaagaugacaggcaaaaguauacagccagagaaccuggaguacaggaucaugcuaagcguccacggcagccaacacagcggcaugaucgucaacgacacaggccacgaaacugacgaaaaccgagccaaaguagagauaacacccaacagcccgcgcgcagaggcaacacugggcggguucgggagccugggacuagacugcgaaccgagaacgggccuggacuucagcgaccucuacuacuuaaccaugaacaacaaacacuggcuaguccauaaagagugguuccacgacauaccacuaccauggcacgcaggcgcagacaccgggacaccacacuggaacaacaaagaagcccuggucgaguucaaggacgcacacgccaaaagacagacagucgugguccugggcucgcaagaaggagccguccacaccgcccucgcgggagcacuagaagccgagauggacggggccaaagggcgacugagcucgggacaucucaaaugccgccuaaagauggauaaacuccgccucaaaggcguaucauacagcuuaugcaccgcggcauucacauucacaaagauccccgccgagaccuugcacgggaccgugacaguagaagugcaauacgccggaacggauggaccaugcaaagucccagcacaaauggcagucgacaugcaaacccuaaccccaguaggacgccuaauaacggcaaaccccgucaucacagaaucaaccgaaaacuccaaaaugaugcuggaacuagacccaccguuuggcgauagcuacaucguaaucggaguaggagaaaagaaaaucacacaucacuggcaccgaagcggcagcacaaucggcaaagcauuugaagcaacaguacggggcgcaaaacgaauggcaguacuuggagacaccgcaugggauuucgggagcguaggaggggcccugaacucgcuagggaaaggaauccaccaaauauucggggccgcguucaagagccuuuucggaggaaugagcugguucagccaaauucucauagggacgcuccugauguggcucgggcuaaacaccaaaaacggcucaaucagcuuaaugugccuagcacuaggaggcguccuaauauuccuaagcacagccguaagcgcagacguaggcugcugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9418 - RNA, 2317 nt, Artificial Sequence
  ZIKV prME variant mRNA Design 3 opt
gggagaaagcuuaccaugcgccguggugcagacaccucaguaggaaucguaggccuucuccuaaccacagcuauggccgcagaagucacacgacggggaucggccuacuacauguaccucgaccgcaacgacgccggcgaagcaaucagcuucccaaccacccugggcaugaacaagugcuacauacaaauaauggaccucggccacaugugcgacgcaacgaugucauaugaaugccccaugcucgacgaaggaguagaacccgacgacguagacugcuggugcaacaccaccagcaccugggucgucuauggaaccugccaccacaagaaaggcgaggcccgcaggucccgacgcgccguaacgcuacccagccacucaacucgcaaacuacaaaccagaagccaaaccuggcuagaaucccgagaauacacgaaacaccucauaagagucgaaaacuggauauuccgcaacccaggcuucgcccuggcagcagcagcaaucgccuggcuccuaggcagcagcaccucccaaaaaguaauauaccuuguaaugauacugcucauagcacccgcauacagcauacgaugcaucggagucagcaacagagacuucgucgaaggcaugagcggaggcacauggguagacaucguccuagaacacggagggugcgucacgguaauggcacaggacaaaccaacagucgacaucgaacucguuaccacaaccguaagcaacauggcagaggucagauccuacugcuacgaagcauccauaagcgacauggcauccgacagccgaugcccaacccaaggcgaggcuuaccuagacaaacaauccgacacccaguacguaugcaagcgaacucuagucgauaggggauggggcaacggaugcggacucuucggcaaaggcuccuuagugacaugugcaaaauucgccuguagcaagaaaaugaccggcaaaagcauccaaccagaaaaccuggaguaccguauaaugcucagcguacacggaagccaacacagcggcaugauagucaacgacacaggacacgaaacagacgaaaaccgugccaaaguagaaaucaccccaaacagcccacgagcugaagccacccuaggaggcuucggaagccugggacuagacugcgaaccccgcaccggccucgacuucuccgacuuauacuaccugacaaugaacaacaaacacuggcuaguacacaaagagugguuccaugacaucccacuacccuggcacgcaggagccgacaccggcacaccgcacuggaauaauaaagaagcgcucguagaguucaaggacgcccacgccaagcgacaaaccgugguaguccugggcagccaagaaggagcaguccacaccgcccuagcaggagcacuagaagccgaaauggacggagcaaaagggcgacucagcucaggacaucucaaaugccgccugaaaauggacaaacuccggcucaagggagucagcuacagccugugcaccgcagccuucaccuucaccaaaauacccgcagaaacccuccacggcaccguaacaguagaaguccaauacgcaggaaccgacggacccugcaaaguaccagcccaaauggcaguagacaugcaaacacucacacccgucgguagauuaauaacagccaacccagucauaaccgaaucgacugaaaacaguaaaaugaugcucgagcuagaucccccauucggggacagcuacauaguaaucggagucggcgagaaaaagaucacacaucacuggcaccgcagcggcagcaccaucggcaaggcuuucgaagcaacaguacgcggggcaaaacggauggccguccuaggcgacacagccugggacuucggcuccguaggcggggcacucaacagccuagggaaaggcauccaccaaaucuucggagccgccuucaaaucgcuguucggaggaaugagcugguuuagucaaauacuuauaggcacccuacucauguggcucggacuaaauaccaaaaacgguuccaucagccucaugugccuagcccuaggcgggguacugaucuuccucucaaccgccgucuccgccgacguaggcuguugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9419 - RNA, 2314 nt, Artificial Sequence
  ZIKV prME variant mRNA Design 3 opt
gggagaaagcuuaccaugagaggagcugacacgagcgucggcauagucggacuccuccuaaccacagccauggcagccgaaguaacacgacguggauccgccuacuacauguaccuggacagaaacgaugcaggcgaagcuaucagcuuccccaccacccucggcaugaacaagugcuacauacagaucauggaccuaggccacaugugcgacgcgacgaugagcuacgaaugcccgaugcucgacgaaggcguggaacccgacgacgucgacugcuggugcaacacaaccagcaccuggguugucuacggcacgugccaccacaagaaaggagaagcacgccgaucccgcagagccguaacccuacccucacauuccacaagaaaacuacaaacccgaagccaaacauggcuagaaagccgcgaguacacaaaacaccuaauaagaguagaaaauuggauauuccgaaaccccgguuucgcccucgcagccgccgcgaucgccuggcuacuaggauccuccacuagccaaaaaguaaucuaccucgucaugauacuacucauagccccagccuacuccauccgcugcaucggagugucaaacagggacuucguagaaggcaugagcggaggcacgugggucgacaucguacuagaacacggcgggugcgucacagugauggcccaggacaaaccaaccguagacaucgagcuagucacgaccacaguaagcaacauggcugaagucagaucguacugcuacgaagccuccaucuccgacauggcauccgacucccgcugcccaacccaaggcgaagcauaccucgacaaacaaucggacacccaauauguaugcaaacgcacacucguagacagaggauggggcaacggcugcggacuauucggaaaagggagccuagucacuugugccaaauucgccugcagcaagaaaaugaccggaaaaaguauccaacccgaaaaccuagaauaccgcaucaugcucuccguccauggaucccaacacagcggcaugaucguaaacgacaccggccacgaaacagacgaaaaccgcgccaaagucgaaaucacccccaacuccccaagagcagaggccacccugggaggauucggaucacuaggccucgauugcgaaccgcggaccggccuagacuucucagaccuguauuaccuuaccaugaacaacaagcacuggcucguacacaaggaaugguuccacgauauaccacuacccuggcacgccggcgccgacacaggcacaccccacuggaacaacaaagaggccuuagucgaguucaaagacgcccacgcaaagcgucaaaccguagucguacuuggaucgcaagaaggcgccguccacaccgcccucgcaggggcccucgaagcagaaauggacggcgcgaaagggcgccuauccagcggacaccucaaaugcagacuaaaaauggauaaacuccgccugaaaggcgucucauacucccucugcaccgccgccuucaccuucacaaaaauccccgcagaaacccuccacgggacaguaaccgucgaaguccaguacgccggaacagacggacccugcaaaguaccugcgcaaauggcaguagacaugcaaacccuaacccccgugggacgacuaauaacggcaaacccagucauaaccgaauccacagaaaacucaaaaaugaugcucgagcucgacccacccuucggcgacagcuacaucgucaucggagucggagagaaaaagauaacacaccacuggcacagauccggcagcacgaucggcaaagcauucgaagccaccguacguggagcuaaacgcauggcaguccucggagauacagccugggacuucggcuccgucggaggcgcccucaacagccuaggcaaaggaauacaccaaauauucggugcagcauucaagucccucuucggcggcaugagcugguucucacagauccucauugggacccuacucauguggcuaggucuaaacaccaaaaacggcuccaucucccucaugugccuggcacuagguggcguacucaucuuccucucgaccgcgguuucagccgacgucgggugcugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9420 - RNA, 2311 nt, Artificial Sequence
  ZIKV prME variant mRNA Design 3 opt
gggagaaagcuuaccaugggcgcggacacaagcgucgggaucguaggccuucugcucacgaccgccauggcagccgaagucacgcgacggggaucggccuacuacauguaccuugacagaaacgacgccggugaagcaauauccuucccuaccacccucggaaugaacaaauguuauauacagaucauggaccucggccacaugugcgacgcaaccaugucauacgaaugccccaugcuagacgaaggaguggagccagacgacguggacuguuggugcaacacaacgagcacauggguaguuuacggaacaugccaucacaagaaaggagaagcuagaagauccagacgcgcagucacacuaccaucccacagcacgcgcaaacuccagacacgcagccaaacauggcuggagucaagggaauacacaaaacaccucauacgagucgagaacuggaucuuccgcaaccccggauucgcacucgcagccgcagcaauagcauggcuucucgggagcuccaccagccaaaaaguaaucuaccucguaaugauacuccuaaucgcaccagcguacuccauaagaugcauaggcguaagcaaccgagacuucgucgaaggaaugagcgguggaacguggguugacaucguacuggaacacggggguugugucacggucauggcacaagacaaaccaacgguggacaucgagcuaguaacaacgaccgucagcaacauggcagaaguccgauccuacugcuacgaagcaucaaucagcgacauggccucagacucccgaugccccacccaaggagaagccuaccuagacaagcaauccgacacucaauacgucugcaaaagaacgcuagucgaccguggauggggaaacggcugcgggcuauuuggaaaaggaucucuagucacuugcgcaaaauucgcguguagcaagaaaaugacaggaaaaagcauacaaccggaaaauuuagaauacaggauaaugcucuccguccacggcucccaacauagcggcaugaucgucaacgacacaggucacgaaacagacgaaaacagggccaaaguagaaaucacccccaacucaccgcgcgcagaagcaacacugggcggcuucggcucacuaggccucgacugcgaaccacgcacuggcuuagacuucagcgaccucuacuaccugacaaugaacaauaaacacuggcuaguccacaaagaaugguuccacgacauaccgcuaccauggcaugcaggagcggacacaggcacaccacacuggaacaacaaagaagcccucgucgaguucaaagacgcccacgcaaaaagacaaacggucguaguccuaggcucccaagagggggcaguacacacagcacucgcaggagcacucgaagccgagauggacggagcgaaaggccgacuaucaucgggacaccucaaaugcaggcucaaaauggacaaacugcggcuaaaaggagucuccuacucacucugcacagcggccuucacuuucaccaaaaucccagccgaaacccuacacggcaccgucaccguggaaguacaauacgccggcaccgacggcccgugcaagguaccagcccaaauggccguagacaugcagaccuugaccccaguaggaagacuaaucacagccaacccggucauaacagaaagcaccgagaacuccaaaaugaugcuggaacuggacccacccuucggagacagcuauaucgucauaggaguuggagagaaaaagaucacccaccacuggcaccgaagcggaucaaccaucggcaaagccuucgaagccacaguccgaggcgcaaaaagaauggccguccuaggcgacacggccugggacuucgggaguguagguggagcacucaacucacucggaaaaggcauccaccaaauauucggggccgccuucaagagccuauucggaggcaugagcugguucucgcaaauacuaaucggcacacugcucaugugguuaggccuuaacacuaaaaacggcaguaucagccuaaugugccucgcacucggaggcgugcucauauuccugagcacagcagugagcgcggacgugggaugcugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9421 - RNA, 2308 nt, Artificial Sequence
  ZIKV prME variant mRNA Design 3 opt
gggagaaagcuuaccauggcagacaccagcgucggcauaguagggcuacuacucacaacagcaauggcagccgagguaacacggcgcggcucagccuauuacauguaccucgacagaaacgacgcaggagaagcaaucagcuuccccaccacgcuaggcaugaacaaaugcuacauacaaauaauggaccuaggccacaugugcgacgcuacaaugaguuacgaaugcccaaugcuggacgaaggcguagaaccagacgacgucgacugcuggugcaacaccacuagcaccugggucgucuacggaaccugccaccauaagaaaggggaagcgcgccgcagccggcgagcgguaacacuccccagccacagcacgcgcaaacuccagacccgcagccagacauggcuagaauccagagaauacaccaaacaccuaauaagaguagagaacuggaucuuccgcaacccaggauucgcccucgccgccgcagccauagccugguuauuaggcuccuccacaagccagaaaguaaucuaccucguaaugauacuccuaaucgcacccgcauauuccauaagaugcauaggcguaagcaaccgcgacuucguugaagggaugucgggcggaaccugggucgacaucgugcucgaacacggaggaugcgucacggucauggcccaagacaaacccaccgucgacaucgaguuagucacuacaacaguguccaacauggccgagguacgcuccuacugcuacgaagcaagcauauccgacauggccuccgacagucgcugcccaacacagggagaagcauaccucgacaaacagagcgacacacaauacguaugcaaacgaacccuaguagaccgaggauggggcaacggaugcggacuauucggcaaaggcucccuagugaccugcgcaaaauucgcaugcucaaagaaaaugacgggaaaaagcauacaaccagaaaaccucgaguaccgaauaaugcuaucgguccacggcagccaacacagcggaaugauaguaaacgauaccggacacgaaacagacgaaaacagagccaaaguagagauaacucccaacagcccacgagcugaagcgacucugggaggauucggcagccugggccucgacugugaaccgcgcaccggccuagacuucucagaucuuuauuaccucacuaugaauaacaaacauuggcucguacacaaagaaugguuccaugacauaccacuaccauggcacgccggagcagacaccggcaccccacacuggaacaacaaagaggcccucguagaguucaaagacgcccacgcgaaacgacaaacagucgugguucuaggcucacaagaaggagcgguccacaccgcgcuagcuggcgcacucgaagcagaaauggacggagcaaaaggacggcucagcuccggccaccucaaaugccgacuaaaaauggacaagcuccggcugaaaggagucagcuacucccucuguaccgccgccuucaccuucacaaaaaucccagcagaaacacuacacggcacaguaacaguagagguccaauacgcggggaccgacgguccaugcaagguaccagcccaaauggcaguagacaugcagacccuaacgcccguaggacgccugauaaccgcaaacccaguaauaaccgaaagcaccgaaaacagcaaaaugaugcuggaauuagacccgccauucggcgacagcuauaucgucauuggcgucggcgaaaagaaaaucacccaccacuggcaccgcaguggauccacaauaggaaaagcauucgaggcaaccguacgaggcgcaaaacgaauggccguccucggagauacagcgugggacuucggcuccgucggcggagcacucaacagccuagggaaagguauacaccaaauauucggcgcagcuuucaaaagccuauucggaggaaugagcugguucagccaaauacuaaucggcacacuccucauguggcucggacucaacaccaaaaacgggagcauaagccucaugugccuggcgcucggaggcguacucaucuuccucucaacggcaguaagcgcagacgugggaugcugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9422 - RNA, 2305 nt, Artificial Sequence
  ZIKV prME variant mRNA Design 3 opt
gggagaaagcuuaccauggacaccuccgucggcauagugggacuccuccuuacuaccgccauggcagcggaaguaacccgacgcggcucagcauacuacauguaccuggaccgcaacgacgcaggcgaggccaucagcuuucccaccacccugggaaugaacaaguguuacauacaaaucauggaccucggccacaugugcgacgcaaccaugagcuacgaaugcccaaugcucgacgaaggaguagaacccgacgacguagacugcuggugcaacacaaccucgacaugggucguauacggaaccugccaccacaagaaaggcgaggcccgccguucacgccgagccgucacacuaccaucccacuccacaagaaaauuacaaacgcgcucacaaacauggcucgaguccagagaauacaccaaacaccuaauccgaguagaaaacuggaucuuccgaaaccccggcuucgcccucgccgcagccgcaauagcguggcuccucgguuccagcaccucccaaaaagucaucuaccuaguaaugauacuacuaaucgcuccagcuuacuccauaagaugcauaggcguauccaaccgggacuucgucgaaggcaugaguggcggcacaugggucgacaucguccuagagcacgggggcugcguaacagucauggcccaagacaaaccaacggucgacauagaacucgucaccaccacagucucaaacauggcagaaguccgcuccuacugcuacgaagcgagcaucagugacauggcaucagacagccgcugcccaacccaaggagaagccuaccuagacaaacaauccgauacucaauacgucugcaaaagaacauuaguggacagaggcuggggaaacggcugcggccucuuuggaaaaggcagccuaguaacaugcgccaaauucgcuugcucuaagaaaaugaccggcaaaucaauccaacccgaaaaccuggaguaucgcaucaugcuaagcguacacggcagccaacacagcggaaugauaguuaaugacaccggccacgaaacagacgaaaaccgcgcaaaagucgaaaucacccccaacucaccccgcgcagaagccacccuaggcgguuucggcucacucggcuuagacugcgaaccacguacaggacuagacuucucagaccuguacuaccucaccaugaauaacaagcacuggcucguccacaaagaaugguuccacgacauaccccugccauggcacgcgggagcggacaccggcacaccccacuggaacaacaaagaagcccuaguggaguucaaagacgcccacgcaaaacgccaaaccguagucguucucggaagucaggaaggggccguccacacagcccuagccggagcccucgaagcagaaauggacggugcgaaagggcgacucuccucuggacaccucaaaugccgcuuaaaaauggacaaacuacggcucaaaggagucuccuacagccucugcacggccgccuucaccuucacaaaaauccccgccgaaacacuccacggaacagucacaguagaaguccaauacgccggaaccgacggccccugcaaagucccagcacaaauggcagucgacaugcaaacacucacacccguaggcagacucaucaccgccaacccagucauaacagaaucaacagaaaauuccaagaugaugcuggaacucgaucccccauucggcgacucauauaucgucauaggagugggagaaaagaaaaucacacaccacuggcaucgcucaggaagcaccaucggcaaagcauucgaagcuaccguccgaggagcgaaacggauggccguacuaggcgacacggccugggacuucggcuccguaggcggagcccucaauucccuagggaaaggcauccaccaaaucuucggcgccgccuucaaaucccuauucggcggcauguccugguucagccaaauacuaaucggaacacuacucauguggcuaggacucaacaccaaaaacggcuccaucagccucaugugccuagcucugggcggaguccucaucuuccucagcaccgcuguauccgccgacgucggcugcugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9423 - RNA, 2302 nt, Artificial Sequence
  ZIKV prME variant mRNA Design 3 opt
gggagaaagcuuaccaugaccagcgucgguaucguaggccuacuacuaacgaccgcaauggcugccgaaguaacaagacgcggcagcgcguacuacauguaccucgaccgaaacgacgcaggcgaagcaaucagcuucccgaccacacuaggcaugaacaaaugcuacauacaaauaauggaccucggucauaugugcgacgcaacaaugaguuacgaaugcccaaugcucgacgaaggaguagagcccgacgacgucgacugcuggugcaacaccaccagcacaugggucgucuacggaacgugccaccacaagaaaggcgaagcccgcagaucccgccgcgcagucacccuccccagccacucaacgagaaaacuccagacccggucacaaacguggcucgaaucccgagaguacacaaaacaccucauacgcguggaaaauuggaucuuccgcaaccccggcuucgcacucgccgcagccgccauagccuggcuacucggauccucaacaucccaaaaagucauauacuuaguaaugauccuacucauagcaccagcuuacagcauccgcugcauaggcguauccaacagagacuucgucgaaggaaugagcggcggaaccuggguagacauaguccuggaacacgggggaugcguaaccgugauggcacaggacaaacccacagucgacauagaacucgugacaacaacgguaaguaacauggcggaaguucgcagcuacugcuacgaagccucaaucuccgacauggcaagcgacucacggugcccaacgcagggcgaagccuaccuagacaaacagucagauacacaauacgucugcaaacgaacccucguagaccggggcuggggcaacggaugcggccucuucggaaaaggaucacucgucacaugcgcaaaguucgcaugcaguaagaagaugacgggcaaaagcauccagccagagaaccucgaauaccgcauuaugcucucaguccacggaucccaacacucaggcaugaucgugaacgacacaggacacgaaacagacgaaaaccgagcgaaaguagaaauaaccccaaacagccccagagcagaagcaacccucggcggcuucggcagucucggacuagacugcgaaccaagaacaggccucgacuucagcgaucuguacuaccuaacgaugaacaacaaacacuggcucguacacaaagaaugguuccacgacauaccacucccguggcacgcaggagcagacacgggcacaccccauuggaacaacaaagaggcccuagucgaguucaaggacgcccacgccaaacggcagaccgucgugguacuaggcucacaagaaggagcagugcacacagcacuagcaggagcacuugaggcagaaauggacggcgccaaaggucgacugucaagcgggcaccuaaaaugucgccuaaaaauggacaaacuacgccucaaaggcguaagcuauagccucugcaccgcagcguucacguucacgaaaauaccggcagagacccuacacggcacaguaacgguugaaguccaauacgccggcaccgacgggccaugcaaagucccggcccaaauggccgucgacaugcaaacgcuaacaccggucggacgccucaucacagccaacccggucaucacagaaagcacagagaacaguaaaaugaugcuagaacuagacccacccuucggcgacucauacaucguaauaggcguaggagagaagaaaauaacccaccacuggcacagaagcggcaguaccauaggcaaagcauucgaagcaaccguaagaggcgccaaacgcauggcaguacuaggcgacaccgccugggacuucggcagcguaggaggagcccuaaacucccucggcaaaggcauacaccaaauauucggcgcagccuucaaaagccucuucggcgggaugagcugguucucccagauacuaauaggcacccuacuuauguggcuaggacuaaacaccaaaaacggaagcaucagccucaugugccucgcacucggcggaguacuaaucuuccucuccacagcggucucagcagacgucggcuguugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9424 - RNA, 2302 nt, Artificial Sequence
  ZIKV prME variant mRNA Design 3 opt
gggagaaagcuuaccaugaccucaguuggaaucgucggccuacuucugacaaccgccauggcagccgccgucacacgcaggggcucagcauauuacauguaccuggaccgaaacgacgccggggaggccaucuccuuccccaccacccucgggaugaacaaaugcuacauccaaauaauggaccugggccacaugugcgacgcgaccauguccuacgagugccccaugcucgacgagggaguagaacccgacgaugucgacugcuggugcaacaccacgagcaccuggguggucuacggaacgugccaccacaagaaaggcgaagcccgacgcucccgcagggcggugacccuacccagccacagcacacggaaacuacaaaccaggucccagacauggcucgaguccagagaauacaccaaacaccuaauucgcgucgaaaacuggaucuucagaaacccaggauucgcccuagccgcagccgccaucgcauggcuccucggcucaagcacaagccaaaaagucaucuaccuagucaugauacugcuaaucgcccccgccuacucaauccgcugcaucggaguaucaaaucgcgauuucguugagggaaugagcggaggcaccugggucgacaucguccucgaacacggcggcugcguaacagucauggcucaagacaaaccaacaguagacaucgagcuaguaacaaccaccguaagcaacauggcagaaguacggucauacugcuacgaagcaucuauaucagacauggccucagacucacgaugcccaacucaaggggaagcauaucucgacaaacaaagcgacacccaauauguaugcaaacgaacacucguugacagaggcuggggaaacggcuguggccucuucggcaaaggcucccuugucacaugcgcaaaauucgccugcucgaagaaaaugaccggcaaaagcauacaaccagaaaaccuggaauacagaauaaugcugagcguacacggcucgcaacauagcggcaugauaguaaaugacaccggacacgaaaccgacgaaaaccgagccaaaguagaaaucacccccaauucuccccgcgccgaagccacucugggaggcuucggaucccuaggccucgacugcgaaccaagaaccggacuagacuucucagaccuauacuaccuaacaaugaacaacaaacacuggcuuguccacaaagaaugguuccacgacaucccccuacccuggcacgcaggcgccgacacaggaacgccccacuggaacaacaaagaagcacucguagaguucaaagacgcccacgcgaaacgccaaaccguagucguccugggcucacaagaaggagcaguccacaccgcgcucgccggugcacucgaagcagaaauggacggcgccaaaggccgacuaagcuccggccaucuaaaaugccgucuaaaaauggacaaacuccgccuaaaaggagucagcuacucacuguguacagcagccuucaccuucaccaaaaucccggccgagacgcuacacggcaccgucaccgucgaaguucaguacgcagggaccgacggacccugcaaaguccccgcccaaauggcgguagacaugcaaacccugaccccggucggaagacuuauaaccgcaaaccccguaaucaccgaaucaaccgagaacagcaaaaugaugcuggagcuagacccacccuucggcgacuccuacaucguaaucggcgucggcgaaaagaaaauaacccaccacuggcaccgaucgggaucaaccauaggaaaagcguucgaagcaaccguccgcggagcaaaacggauggccgugcuaggagacacagcaugggacuucggaagcguaggaggcgccuuaaacucacuaggcaaaggcauacaccaaaucuucggcgccgccuucaagagcuuauucggaggcaugagcugguucucccaaauccuaaucggcacacuccucauguggcugggacucaacaccaaaaacgggagcauaucgcucaugugccucgcccuggguggcguccuaaucuuccuaucgacagccgucuccgccgacgucggcugcugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9425 - RNA, 2314 nt, Artificial Sequence
  ZIKV prME variant mRNA Design 3 opt
gggagaaagcuuaccaugcgcggcgccgacaccagcguaggcaucgucggacuacuccucaccacagccauggcagccgcaguaacacgacgaggaucagccuacuacauguaccuggacagaaaugacgccggcgaagccaucagcuuuccaacaacucucgguaugaacaagugcuacauacaaauaauggaccucggccacaugugcgacgcaacaaugagcuacgaaugccccaugcuagacgaaggggucgagcccgacgacguagacugcuggugcaacaccaccucaaccugggugguauacggaacaugccaccacaagaaaggcgaagcucgacgcagcagacgagccguaacacucccaagccacagcacaagaaaacuccaaaccagaagccaaacauggcucgaauccagagaauacacaaaacaccuaauuagaguagaaaacuggauauucagaaaccccgguuucgcacucgccgccgccgcaauagcauggcuacucggaagcuccaccucgcaaaaagugaucuaccucgucaugauccuacuaaucgcaccagccuacuccaucagaugcaucggagucuccaaccgagacuucgucgaaggaaugagcggcggaaccuggguagacaucgugcuagaacacggcggaugcgucacuguaauggcacaagacaaaccaacagucgacaucgaacucguaaccacaacggucuccaacauggccgaaguccgauccuacuguuacgaggccagcauaucagauauggcauccgacagccgaugccccacccaaggcgaagccuaccuagacaaacaaagcgacacccaauacguaugcaaacgcacccucguugacagaggcuggggaaacggaugcgggcuauucggcaagggcucacucgucacaugcgccaaauucgccugcagcaaaaagaugaccgggaaaagcauacaacccgaaaaccuagaauaccgaaucaugcuaucagugcacgggucacagcauagcggcaugaucgucaacgacaccggacacgagacggacgaaaacagggccaaagucgagaucacccccaacucaccgcgcgcagaagccacgcucggcggauucggcucauuaggacuggauugcgaaccacguaccggccucgacuucuccgaccucuacuaccucacaaugaauaacaaacacuggcugguacacaaagaaugguuccacgacauaccccuacccuggcacgccggagccgacacaggcacaccgcacuggaacaacaaggaagcccucgucgaguucaaagacgcccacgcuaaaagacaaaccgucgucguacuaggaagccaagaaggcgcagugcacaccgcgcuggcgggcgcacuugaagccgaaauggauggagcaaaaggaagacuaagcuccggacaccugaaaugucgccuaaagauggacaaacuaaggcuaaaaggcguaucguacucacucugcacagcagcauucacuuucacaaaaauacccgccgaaacgcuccacggcaccguaacagucgaaguccaauacgcgggaaccgacggcccaugcaaaguccccgcccaaauggccguggacaugcagacccuaaccccggugggccgccuaauaacagcaaaccccguaaucacugaaagcaccgaaaauucaaaaaugaugcucgaacucgacccacccuucggagacagcuacauagugauaggaguaggagagaaaaagauuacccaccauuggcacagaucaggcagcacaaucggaaaggcuuucgaagcaaccguacgcggagcaaaacgcauggcgguacucggcgacacagccugggacuucggcagcgucggcggcgcacuaaacuccuuaggaaaggguauccaccaaaucuuuggcgcagccuucaaaagccucuucggcggcaugagcugguucucacaaauccucauaggcacacuccucauguggcucggcuuaaacaccaaaaacggauccaucagccuaaugugccuggcacucggcggcguccuaaucuuucuaucaacugccgucagugcagacguaggaugcugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9426 - RNA, 2338 nt, Artificial Sequence
  ZIKV prME variant mRNA Design 3 opt
gggagaaagcuuaccaugcgaggccucagcuccagaaaacgacgaucacacgacguccucacgguacaauuccucauacuagguaugcuacucaugaccggaggagugacacgcagaggcagcgccuacuacauguaccucgaccgcaacgacgcaggagaggccaucagcuuccccacaacccuaggcaugaauaaaugcuacauccaaaucauggaccuaggccacaugugcgacgccacaaugucauacgaaugccccaugcuugacgaaggaguagaacccgacgacguagacugcuggugcaacacaaccagcaccugggucguauacggaacgugccaccacaagaaaggugaagcacgaagaagccgaagggcagucacccuucccagccacucaaccagaaaacuccaaacacgaucccaaaccuggcuagagagccgcgaguauacgaaacaccucauccgcgucgaaaacuggaucuucagaaacccaggcuucgcgcucgcugcagcagcaauagcauggcuccugggaagcagcaccucgcaaaagguuauauaccuagucaugauacuacugauagcacccgccuacagcauacgcuguaucggaguauccaacagagacuucgucgaaggaauguccggaggaacauggguagauauagugcucgaacacggugggugcguaaccgucauggcccaggacaaacccaccgucgacauagaacucgucacaaccacgguaucaaacauggccgaaguacgaucauacugcuacgaagcaagcauuagcgacauggcguccgacucaaggugcccaacccaaggagaagcauaccuagacaaacaaagcgacacgcaauacgugugcaagcgaacccuuguagacagaggaugggggaacggaugcggccucuucggaaaaggcagccuaguaacaugcgcaaaauucgcaugcagcaagaaaaugaccggaaaaucgauacaaccagagaaccucgaauacagaauaaugcucagcguccacgguucacagcacagcggcaugauagugaacgacacagggcacgagaccgacgaaaaucgcgcuaaagucgagauaaccccaaacagcccacgagcagaagccacccucgggggcuucggaucacuuggacuagacugcgaaccacgaaccggacuagauuucagcgaccucuacuaccuaacaaugaacaacaaacacuggcucguacacaaagaaugguuccacgauaucccguuaccauggcacgcaggagccgacacaggaacuccccacuggaacaacaaagaagcacucguggaguucaaggacgcucacgcaaaacgccaaaccguggugguccuaggaagccaggaaggagccguucacacagccuuagccggagcacuagaagcggagauggacggggccaagggccgccugagcaguggacaccucaagugccgacugaaaauggacaaacuaagacuaaaaggagucucguacagccuaugcacagcagccuucaccuucacaaagauaccggccgaaacacuacacggcacagugacaguagaaguacaauacgcaggaaccgacggccccugcaaaguacccgcccaaauggcaguagacaugcaaacccucacacccguaggcaggcuaaucacggcgaacccaguuauaacggaaagcacggagaacagcaaaaugaugcuagagcuggacccaccauuuggagacucguacauaguaaucggagucggagaaaagaaaaucacacaccacuggcaccguuccggcagcacgauaggcaaggcguucgaagcaacagucagaggcgccaagaggauggcgguacucggagacaccgccugggacuucggcucagugggcggcgcgcuaaacucacucggaaaaggcauacaccaaauauucggagccgcauucaaaagucuuuucggaggcaugagcugguucagccaaauccugauaggcaccuuacuaauguggcucggcuuaaacaccaaaaacggaaguaucucacucaugugcuuagcccugggcggaguucucauauuccuuagcaccgcagucagcgccgacguugggugcugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9427 - RNA, 2338 nt, Artificial Sequence
  ZIKV prME variant mRNA Design 3 opt
gggagaaagcuuaccaugcgcggccucucuagccgcaaacgcagaagccacgacgucuuaacuguacaauucuuaauccucggcaugcugcuaaugacaggggcaguaacacgccgaggauccgcuuacuauauguaccuggaccggaacgacgcaggcgaagccauauccuucccaacaacccugggcaugaacaaaugcuacauacaaauaauggaccuaggucacaugugcgacgcgaccaugagcuacgagugccccaugcucgaugaaggagucgaacccgacgacgucgacugcuggugcaacaccacgucuaccuggguagucuacggaaccugccaccacaaaaagggagaagcacggcgaucuaggcgagcaguaacgcuaccaucacauagcacgcggaaacuccagacacgaucccaaaccugguuagaaagccgagaguacaccaaacaccugauaagaguagaaaacuggaucuucagaaacccaggauucgcucuagcggcagcagccaucgccuggcuccuuggaucaucaacaucucaaaaaguaaucuaccucguaaugauccuccucaucgcaccggcauacagcauacgcugcaucggcgucucaaacagagacuucguagaagggaugagcggcggcacauggguagacauaguacucgaacacggcggcugcguaaccguaauggcgcaggacaaaccaaccgucgacaucgagcuagucacgaccaccgucucaaacauggcugaaguccgaucauacugcuacgaagcaagcaucagcgauauggccuccgacaguagaugccccacccaaggagaagccuaccuugacaaacaauccgacacccaauacguaugcaagcgaacccucgucgaccgcggcuggggcaacggcugcggccuauucggcaaaggcagccucgucacaugcgccaaauucgccugcagcaagaaaaugaccggaaaaucaauacaaccagaaaaccucgaauaccgaaucaugcucagcguccacggcagccaacacuccggcaugauagucaacgacacaggccacgaaacagacgagaaccgugccaaaguagagauaacacccaacaguccccgugccgaagcaacccucggcggcuucggcucccuaggccuggacugcgaaccacgaaccggacuagacuucagcgaccuauacuaccuaacaaugaacaacaagcacuggcugguacacaaagaaugguuccacgacaucccccuccccuggcacgcgggcgccgacacgggaaccccacacuggaacaacaaagaagcccucgucgaguucaaagacgcgcacgcaaaaagacaaacagucgucguauuaggcucacaagaaggcgcaguacacacagcccuagcuggagcccucgaagcagaaauggacggggcaaaaggccgacucagcagcggacaccucaaaugccgccuuaaaauggacaaacuacgacuaaagggagucagcuacucacucugcaccgccgcauucacguucaccaaaauccccgccgaaacccuccacggaaccguaacaguagaaguacaauacgcaggcaccgacggucccugcaaagucccagcccaaauggcaguagacaugcagacacuaacgccuguagggagacuaauuacagcaaacccugucaucacggaaucaaccgagaacagcaaaaugaugcuagaacuagaucccccauucggagacaguuacaucguaauuggagucggagaaaagaagauaacgcaccacuggcacagaagcggcucaacaauaggaaaagcauucgaagccacaguccggggagccaagagaauggccguacugggggacaccgcaugggacuucggaagcgugggcggagcacuaaacagccuaggcaaagggauacaccaaauauucggcgccgccuucaaaucacucuucggaggcaugagcugguucagccagauucuuaucggcacacuacuaauguggcucggccugaacaccaaaaacgguagcauaucacucaugugccuugcccucggagguguacuaaucuuccugagcaccgccgucagcgcagacguaggaugcugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9428 - RNA, 2338 nt, Artificial Sequence
  ZIKV prME variant mRNA Design 3 opt
gggagaaagcuuaccaugcgaauaauaaacgcacgaaaagagaagaaaagaagaggcgccgacacaagcgugggaauagucggccuacugcuaacaacagccauggccgccgaagucacgcgucgaggauccgccuacuacauguaccucgaccgaaacgacgccggcgaagccauauccuucccaacaacccucggcaugaacaaaugcuacauccaaauaauggaccugggacacaugugcgacgccaccaugucauacgaaugcccaaugcuagacgaaggcgucgaaccagacgaugucgacugcuggugcaacacaacuagcacauggguaguauacggcacaugccaccacaagaaaggggaagcccgccgcagccggagggccgucaccuuaccaucccacucaacgcgcaaacuccaaacccgaagccaaacauggcucgaaucgcgagaauacaccaaacaccucauccgggucgagaacuggaucuuucgaaaccccggguucgcccuagcggcggcggcaauagcauggcuacucggcucaucaacgucucaaaaagucauuuaucuagucaugauacugcuaaucgccccagcguacucaauacggugcaucggaguaucaaaccgcgauuucguggagggcaugucaggcggaaccuggguagacauagugcuagagcacggaggcuguguuacugucauggcccaggacaaacccaccguggacaucgagcuaguaacaacaaccguauccaacauggcagaaguccguucauacugcuaugaagccuccaucuccgacauggcaucagauagcagaugcccaacacagggcgaagcauacuuagacaaacagucagacacgcaauacguuuguaaacgcaccuuagucgacagaggcugggggaacggaugcgggcuauucggcaagggcucgcuaguaaccugcgccaaauucgcaugcagcaagaagaugaccggcaaauccauacaaccagaaaaccucgaauacagaauaaugcuaucuguccacggcagccaacacagcggaaugauugucaacgacacaggccacgaaacggacgaaaaccgagccaaaguagaaaucacacccaacucaccgcgagccgaagcaacccucgggggcuucggcucccuaggacucgacugcgaaccccggaccggccucgacuucagcgaccucuacuaccuaaccaugaacaacaaacauuggcuaguccacaaagaaugguuccacgacaucccccuuccauggcaugcaggagcagacacaggcacaccccacuggaacaacaaagaagcgcuaguagaguucaaagacgcacacgcaaaacgacaaacagucgucgugcugggaucccaagaaggcgcuguccauacagcacucgcaggcgcacucgaagccgagauggauggcgcaaaaggacgacuaagcuccggacaccucaaaugcagacugaaaauggacaaacucagacuaaaaggagucucauacucccuaugcaccgccgcguucaccuucaccaaaauaccagcagaaacacuccacggaacggucaccgucgaaguacaauaugcaggcacagacggaccgugcaaagucccggcccaaauggcagucgauaugcaaacacuaaccccagucggccgccugaucacugcaaaccccguaaucacagaaagcacagaaaacuccaaaaugaugcucgaauuggacccacccuucggggauagcuacaucguaaucggcgucggcgaaaagaaaauaacacaccacuggcaccgcagugggagcacuauaggcaaagcauucgaagccaccguucgcggagccaaacgcauggccguacucggcgacacagccugggauuucggcucaguaggcggcgcccuaaacucccuagggaaaggcauccaucaaauauucggagcugcguucaaaagccuauucggaggaaugagcugguucucccaaauacucaucggcacacuacugauguggcucggccuaaacaccaaaaacggauccauaagccuaaugugccucgcacucggcggcgugcucaucuuccucagcacagccguaagcgcagacugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9429 - RNA, 2335 nt, Artificial Sequence
  ZIKV prME variant mRNA Design 3 opt
gggagaaagcuuaccaugaucauaaacgcacgcaaggaaaagaaacgaagaggcgcugacacaagcgucgggauaguaggccuccugcuaaccaccgcaauggcagcagaagugacucgccguggcagcgcauacuacauguaccucgaccguaacgacgcaggggaagcaauaaguuuccccaccacacucggcaugaacaaaugcuacauccaaaucauggaccucggccacaugugcgacgccaccaugagcuacgagugccccaugcucgacgagggagucgaaccagacgacguagacugcugguguaacacgaccucaaccugggugguauacggaaccugccaccauaagaaaggagaagcccgccgaucccgacgcgcaguaacccuccccucacacuccacccgaaaacuacaaacacgcucacaaacauggcuggaaucacgcgaauacaccaaacaccucaucagaguagagaauuggaucuuccgcaaccccggcuucgccuuagcagccgccgccauagcauggcuacucgggagcucuaccagccaaaaggucauauaccuaguaaugauccugcuaaucgccccagcauacagcauacgcugcaucggcguauccaacagagacuucgucgaagguauguccggcggcacaugggucgacaucguccucgaacacggaggcugcgugaccgucauggcccaagauaaaccaaccgucgacauagaacucgucaccaccacaguaucaaacauggccgagguacgcucauacugcuacgaagcauccauauccgacauggcaagcgacucgaggugcccuacacagggcgaagccuaccuagacaaacaaucagacacacaauacgucuguaaacgcacccuagucgacagaggauggggaaacgggugcggccuauucgggaagggcagccugguaaccugcgcaaaauucgccugcagcaagaaaaugacuggaaaaucgauccaaccugaaaaccuggaauaccgaaucaugcuaagcguccacggaagccagcacucgggcaugaucgucaaugacacaggacacgaaacagacgaaaaucgcgcaaaaguagaaauaacccccaacucgcccagggccgaagccacgcucggcggcuucggaucgcuaggccuugacugcgagcccagaaccggacuagacuucucagaucuguacuaccuaaccaugaacaacaaacacuggcucgugcacaaagaaugguuucacgacauaccccucccauggcacgccggcgcagacacaggcacaccccacuggaacaacaaagaagcacucguagaguucaaagacgcccacgcaaaacgccaaacagucgucgugcuaggcucccaagaaggagccguccacacagcccucgccggcgcccuagaagccgaaauggacggagccaaaggacgacucucaagcgggcaucucaaaugcaggcuaaaaauggauaagcucagacuaaaaggagucagcuacucacuaugcaccgccgccuucaccuucaccaaaauacccgcggaaacacuacacggaacaguaaccgucgaaguccaauacgccggcaccgauggcccgugcaaaguccccgcucaaauggccgucgacaugcaaacauuaacgcccguaggccgccucaucacagcaaauccagucauaacggaaagcacagaaaacagcaaaaugaugcucgaacucgacccgcccuucggagacaguuacaucgucauuggcguaggcgaaaagaaaauaacacaccacuggcacagaagcggaucgaccauaggcaaagcauucgaagcaaccguccgaggcgccaaaagaauggccguacucggagauacagcaugggacuucggaucagucggcggagcccuaaacucccucggcaaagguauacaccaaaucuucggagccgccuucaaaagccucuucggaggcaugucgugguucagucaaauacucauaggaacacuacucauguggcuaggccuaaacaccaaaaacggcucuaucagccucaugugccuagcacuaggaggcguccuaaucuuccucagcacagcgguauccgccgacugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9430 - RNA, 2332 nt, Artificial Sequence
  ZIKV prME variant mRNA Design 3 opt
gggagaaagcuuaccaugaucaacgcccggaaagaaaagaaaaggagaggcgcagacacaagcgucggcauagucggacuccuacucacaaccgccauggcggccgaagucacacggagaggaucggccuacuacauguaccuagaccgaaacgacgccggagaagccaucagcuuccccacaacacuaggaaugaacaaaugcuacauacaaauaauggaccuuggccauaugugcgacgccacaaugagcuaugaaugccccaugcucgacgaaggagucgagccggacgacgucgauugcuggugcaacaccacauccacaugggucgucuacggcacaugccaccacaagaaaggagaagccagacgcagcagacgagccguaacacuacccagccacucaacacgcaaacuccaaacccgaagccaaaccuggcucgagagcagagaauauaccaaacaccuaaucagggucgagaacuggauauucaggaacccaggauucgcacuagcugccgcagcaauagcauggcuacuaggcagcagcaccagccagaaagugaucuaccucguaaugauacuucucauagcacccgccuacucaauacgaugcauaggcgucagcaaccgcgacuucgucgaaggcaugucagguggaacauggguagacaucgugcucgaacacggcggcugcgucaccgucauggcccaagacaaacccaccguagacauagagcuagugaccacaacaguaagcaauauggccgaagugagaagcuacuguuacgaagccagcaucagcgacauggcguccgacucucgcugcccaacccaaggagaagcguaccuagacaaacaaagcgacacacaauacguaugcaaaaggacccucgucgaccgaggcuggggcaacggaugcggacuguucggcaaagggagccuaguaacaugcgcaaaauucgcgugcuccaagaaaaugacaggaaaaagcauacaaccagagaaccuagaauaccgcaucaugcuaagcguccacggaagccaacacucaggcaugauaguuaacgacacaggccacgagaccgaugagaaccgcgccaaaguggagaucacaccaaacuccccaagagcagaagcgacccuaggaggauucggaucgcucgggcucgacugcgagccaagaacaggccuagacuucuccgaccucuacuaccuaaccaugaacaauaaacauuggcuagugcacaaagaaugguuccacgacauaccgcucccauggcacgccggcgcugacacgggaacgccccacuggaacaauaaagaagcacuggucgaguucaaggacgcacacgccaaaagacaaaccgucguaguacucggaagccaagaaggcgccguacacaccgcacuggccggagcccuagaagcagaaauggacggcgcgaaaggaagacucagcucaggacaccugaagugccggcucaaaauggacaaacuccgacucaaaggaguaagcuacagccucugcacagccgccuucaccuucaccaagaucccggcagaaacccuucacggcaccgucacaguagaaguacaauacgcagguacagacggacccugcaagguccccgcacaaauggcaguagacaugcaaacccugacaccaguugggagacugaucaccgcaaacccagugaucaccgaaucaaccgaaaacagcaaaaugaugcuagaacucgacccaccauucggggacagcuacauaguaaucggcgugggagaaaagaaaauaacacaccacuggcaccgcucaggcaguacuauaggaaaagccuucgaggccacaguccguggggccaaaagaauggcgguacuaggcgacaccgccugggacuucggcagcguagggggcgcacuaaacucacucggaaaagggauucaccagauuuucggcgcagccuucaaaagccucuucggaggaaugagcugguucagccaaauacucauaggaacgcuacugauguggcugggccucaacaccaaaaacgggucaauaagccucaugugccuagcccuaggcggaguccuaauauuccuauccacagcagucagcgcagacugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9431 - RNA, 2329 nt, Artificial Sequence
  ZIKV prME variant mRNA Design 3 opt
gggagaaagcuuaccaugaaugcacgaaaagaaaagaaacgacgaggagcagacacuucagucggcaucgugggccugcuacucacaacagcgauggccgccgaagucacacgccgaggcucugcuuacuacauguaccucgaucgaaacgacgccggggaagcaaucucguuccccaccacgcugggaaugaacaaauguuacauacaaaucauggaccucggccacaugugcgacgccaccauguccuacgaaugcccaaugcucgacgaaggaguagagccagacgacgucgacugcuggugcaacaccaccagcacguggguagucuacgggacgugccaccauaagaaaggagaagcacgcagaaguagacgagcagucacccuaccaagccacucaacccgcaaacuacaaaccagaucucaaacguggcucgaaagucgcgaguacacuaaacaccucauacgcgucgaaaacuggaucuuccgaaaucccggauucgcgcuggcagcagcagccauagccugguuacugggcagcuccaccagccaaaaaguaaucuaccuugugaugauccuacuaaucgcuccagccuacagcauccgaugcauaggcgucagcaaccgagacuucgucgagggcauguccggcggaaccuggguagacaucguacuagaacacggcgggugcgucacagucauggcacaagacaaacccaccgucgacauagagcuaguaaccacgacaguaagcaacauggcagaagucagaagcuacuguuacgaagcaucaauauccgacauggcaagcgacucccgaugccccacccaaggcgaagcauaccuagacaaacaaagcgacacccaguacgucugcaaaaggacccuagucgaccgaggcuggggaaacgggugcggacuguucgggaaaggcagccucguaaccugcgccaaauucgccugcucaaagaaaaugacgggcaaaagcauacaacccgaaaaccucgaauacaggaucaugcuaucuguccauggcagccaacacuccggcaugauagucaaugauacuggacacgaaacagacgaaaaccgcgccaaaguagaaaucacacccaacagcccccgcgcagaagcaacccucggaggcuucggaucccuaggccucgacugcgaaccacgcaccggccucgacuucuccgaucucuacuaccucaccaugaacaauaaacacuggcugguccacaaagaaugguuccacgacauaccccugccguggcacgccggcgccgacacaggaaccccacacuggaacaacaaagaggcgcuagucgaguucaaagacgcccacgcuaaacgacaaacggucgucguccuaggcucccaagaaggggcgguccacacagcccucgcaggagcccuggaagccgaaauggacggcgccaaaggcagacucagcuccggccaccuaaagugccgccucaaaauggacaaacuaagacugaaaggcgucagcuacagccuaugcacagcagcauucacauucaccaaaauacccgccgaaacccugcacggaacagugacaguagaaguccaauacgccggcaccgacgggcccugcaaaguaccagcccaaauggccgucgacaugcaaacgcucaccccagucggccgacugaucaccgccaacccagucaucaccgaauccacagagaacucaaaaaugaugcucgaacuagaucccccauucggcgacuccuacauaguuaucggcguuggagaaaagaaaaucacgcaccacuggcacaggagcgguucaacaauaggaaaagccuucgaagcgacaguccgcggagccaaacgaauggcgguacugggcgacacugcaugggacuucggcagcguaggcggcgcucucaacucccugggaaaaggaauacaucaaauauucggagccgcauuuaaaucacuguucggaggcaugucaugguucagccagauccuaauaggcacccuccucauguggcucggacuaaacacgaaaaauggaagcauaagccuuaugugccuagcacucggcggaguccuaauauuccucagcacggccgugagcgccgacugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9432 - RNA, 2326 nt, Artificial Sequence
  ZIKV prME variant mRNA Design 3 opt
gggagaaagcuuaccauggcccgaaaagaaaaaaaacgacgaggcgccgacacauccguaggaauagucggccuccuacuaaccacggcuauggcagccgaaguaacgcgccgaggaucagccuacuacauguacuuagacagaaacgacgcaggagaagcaaucagcuucccaaccacgcucggaaugaauaaaugcuacauccaaauaauggaccuaggccacaugugugacgccacuauguccuacgaaugccccaugcuagacgagggcgucgagccagacgacgucgauugcuggugcaacaccaccagcaccugggucguguacgggacaugccaccacaaaaaaggcgaagcacgacgaucccgccgagcagucacccugccaucccauagcacaagaaaacuccaaacccgcagccagacauggcuagaaagccgagaauacacaaaacaccucauccgaguggaaaacuggaucuuucgcaacccaggcuucgcacucgcagcagccgccaucgccuggcuccuaggcucgagcaccagccaaaaagucauauaccucgucaugauacuacucauagccccggcauacuccauccgaugcauuggagucagcaaccgggacuucgucgaaggaaugagcggcggcaccuggguagacaucgugcucgaacacggaggcugcguaaccgucauggcgcaggacaaacccacaguagauaucgaacuagucaccacuacaguaagcaacauggcggaaguacgaagcuacuguuacgaggccagcauauccgacauggcaucggacagcagaugccccacccaaggggaggcauaccucgacaaacaaucagacacgcaauacguaugcaaacggacccuggucgaucgcggauggggcaacgggugcggccucuucggcaaaggcucacucgucaccugcgccaaauucgcaugcuccaagaaaaugaccggcaaaagcauacaaccagagaaccuagaauaccgaaucaugcugucaguccacgguagccaacacagcggcaugaucgucaacgacaccggacacgaaaccgacgaaaauagagccaaaguagaaaucacgcccaacagcccaagagcagaagccacccucggcggguucgguagccuaggccuugacugcgagccgcgcacaggacuggacuucagcgaccucuacuaccugaccaugaacaauaaacacuggcucguacacaaagagugguuccacgacaucccccuacccuggcacgcaggagccgacaccggcacgccacauuggaacaacaaagaagcccucgucgaauucaaagacgcgcaugcgaaaagacagacagucguaguccuaggaucacaagaaggagcgguacauacagcacuagcaggagcgcucgaagcagaaauggacggcgcaaaaggacgacuaucgucaggccaccucaaaugccgacucaaaauggacaaacuaagacucaaaggggucagcuacuccuuaugcaccgccgcauucacauucaccaaaauccccgcagaaaccuuacacggaaccgugaccgucgaaguacaauacgcaggaaccgauggacccugcaaagucccagcacagauggccguagauaugcaaacccugacaccggucggccgacuaauaacagcaaaccccguaaucacugaaucaaccgaaaacucaaaaaugaugcuagaacuugacccacccuucggcgacagcuacaucguaaucggcguaggcgagaaaaaaauuacacaccacuggcaccgauccggaagcacgaucggcaaggcauucgaagcgacgguccgaggagccaaacgaauggcaguccucggcgacacagcgugggacuucggcagcgucggcggcgcucucaacagccuaggcaaaggcauccaccagaucuucggcgccgccuucaaaucccuauucggcggcaugucaugguucagccaaauccuaauaggcacacuccucauguggcucggccucaacacaaaaaacggcucaauaagccuaaugugccucgcccucggcggcguucucauuuuccucagcaccgcagucagcgcggacugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9433 - RNA, 2323 nt, Artificial Sequence
  ZIKV prME variant mRNA Design 3 opt
gggagaaagcuuaccaugcggaaagaaaagaaacgccgaggcgcagacacgagcguaggaauagucggccuacuccugacgacagcaauggcagcagaaguaacacgccguggaagcgcguacuacauguaccucgaccggaacgacgcaggagaagccaucagcuucccaaccacccucggaaugaacaaaugcuacauacaaauaauggaccuaggacacaugugcgacgccaccauguccuacgagugccccaugcuagacgaaggaguagaaccagacgacguagacugcuggugcaacacaacauccacguggguaguauacggaacaugccaccacaagaaaggcgaagcacgccggagccgacgagccgucacgcugccaucccacagcacacgaaaacuacaaacccggucccagaccuggcuagaaucaagagaauacacaaaacaccucauacggguagagaacuggauauucagaaaccccggguucgcacucgcagccgccgcaauagccuggcuccugggcucaagcaccucccaaaaagugauauaccuagucaugauacugcugaucgccccggccuacuccaucagaugcaucggggucagcaacagagacuucgucgaagguaugucuggaggaaccuggguagacauaguacuagaacacggaggaugcgucacggucauggcucaggacaaacccaccguagauauagaacuggucaccacaacgguaagcaauauggccgaaguaagauccuacugcuacgaggccagcauaucagacauggcauccgacucacgcugcccaacccaaggagaagcauaccucgacaaacaaagcgauacgcaauacgugugcaaaagaacccuaguagaccgaggauggggaaacggcugcggccuguucggcaaagggucacugguaaccugugcgaaauucgcgugcucaaagaaaaugacagggaaauccauccaacccgaaaaccucgaguaccgaauaaugcuaagcguccacgggucacaacacuccggaaugaucgucaacgacacaggacacgaaacagacgaaaacagagcaaaaguagaaaucacaccgaacagcccccgugcugaggcaacacucgggggauucgggucccuaggacucgacugcgaaccacgaacgggacuagacuucagcgaccuauacuaucucacgaugaacaacaaacacuggcuagugcacaaagaaugguuccacgacaucccccuacccuggcacgcaggagccgacacuggcacaccccacuggaacaacaaagaagcacugguagaguucaaagacgcacacgccaagagacagaccguagucguacucggaagccaagagggggcggugcacacagcacucgcaggagcgcucgaagcagagauggacggggccaaaggccgacuauccagcggacaccucaaaugccgacuaaaaauggacaaacucagacuaaaaggagucuccuacagccuaugcacagcagccuucaccuucaccaagauacccgcagaaacacuccacggcaccgucaccgucgaaguacaauacgccgggaccgauggaccaugcaaagucccagcgcaaauggcaguggacaugcaaacccuaaccccagucggacgucugaucaccgcaaaucccgucaucacagaauccaccgaaaauagcaaaaugaugcuggaacuggacccacccuucggcgacaguuacauagucaucggagucggagaaaagaaaauaacacaccauuggcacagguccgggagcaccauaggcaaagcauucgaagcaacaguacgaggagccaaaagaauggccgucuugggagacacugcaugggacuucggcuccguaggaggagcacucaacagccucggaaaaggaauccaccagauauucggcgcagcauucaaaucccucuucggaggcaugagcugguucucccaaauacuuauaggcacgcuccuaauguggcuaggccucaauaccaaaaacggaagcaucucucuaaugugccucgcgcuaggaggcguccuaauauuccuaucaacagcaguuucagcagacugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9434 - RNA, 2320 nt, Artificial Sequence
  ZIKV prME variant mRNA Design 3 opt
gggagaaagcuuaccaugaaagaaaagaaacgccgaggggcggacacaagcguggguaucgucggccuacucuuaaccaccgcgauggccgcggaggucacccgacgaggcuccgcguacuacauguacuuagaccgaaaugacgccggcgaagccauaucauuccccaccacgcucggcaugaacaaaugcuacauccaaauaauggaccucggccacaugugcgacgccaccaugaguuaugaaugccccaugcucgacgaagggguagagccagacgacguagacuguuggugcaacacaaccagcacaugggucguguacggaaccugccaccacaagaaaggcgaagcccggcgcagccgccgggcagucacacuccccagccauagcacccgcaaacuacagacccgcucgcaaaccuggcucgaaucaagagaauacaccaaacaccucauccgcgucgaaaacuggauauuucgaaaccccggauucgcccuggcagcagcagcaauagccuggcuucucggcuccagcacaagccagaaagucaucuaccucguaaugauccuauuaauagccccagcuuacuccauccgguguauaggggucuccaacagagacuucgucgaaggcauguccgguggaaccuggguagacaucguacucgaacacggaggaugcgucaccgucauggcccaagacaaacccaccguggacaucgaacucgucacaaccacagucucgaacauggccgaagucagguccuacugcuacgaagcgucaauaucagacauggcauccgacagccgaugcccaacccagggagaagcauaccuugacaaacaaucggacacccaauacgucugcaagcgcacacucguggacagaggauggggcaacggaugcggacuauuuggcaaagggagccuaguaaccugcgccaaauucgcgugcagcaagaaaaugacuggcaaaaguauccaaccagagaacuuagaauaucgaaucaugcucagcguccacggaagccaacacuccggcaugaucgucaacgacacaggccacgagacagacgaaaaccgugccaaaguagaaauaacaccaaauagcccccgagcagaggcaacccucggaggcuucgggagccuaggacucgacugcgagccgaggacgggacuagauuucagcgaccuauacuaccuaacaaugaacaacaaacauuggcuuguccacaaagaaugguuccacgacaucccacuccccuggcacgccggagccgacacuggcacaccucacuggaacaacaaagaagcacucguagaguucaaggacgcccacgcuaaacgccaaacaguuguaguacucggcagccaagaaggagccguccacacagcacucgcaggcgcccucgaagccgaaauggauggagccaagggccgacuaucgucaggacaccucaagugccggcucaagauggacaaacucagacugaaaggaguaagcuacagccuaugcaccgccgccuucaccuucaccaagauccccgcagaaacacuccacggaacagucaccgucgaaguacaguacgccggaaccgacggccccugcaaaguccccgcacaaauggccguggacaugcagacccuaacaccaguaggacgccucauaacagcaaauccaguaauaaccgagucaaccgaaaacagcaaaaugaugcuagaacuagauccacccuucggcgacuccuacauaguaaucggcguaggcgagaagaaaauaacacaucacuggcacagaucagguuccacaaucgggaaagcauucgaagccacaguccgcggagccaaaagaauggcgguacuaggcgacacagccugggacuucggaaguguagguggcgcgcucaacucccuagggaagggaauacaccaaaucuucggcgccgcauucaaaagccuauucggcggaaugagcugguucagccaaauucucauaggcacccuccuaauguggcuuggacucaauacaaagaacgggagcauaucccuaaugugccucgcccuaggcggcguccuaauauuucugagcacagcagucagcgcagacugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9435 - RNA, 2317 nt, Artificial Sequence
  ZIKV prME variant mRNA Design 3 opt
gggagaaagcuuaccauggaaaagaagaggcgaggagccgacaccagcguagggauaguaggccuacuccucacaacagcuauggcagcagaagucacacgacgcggcagugcauacuacauguaccucgaccgaaacgaugccggcgaggccaucagcuuccccaccacacuaggcaugaacaaaugcuacauacaaaucauggaccucggacacaugugcgacgcaacaauguccuacgaaugcccaaugcucgacgaggggguagaacccgacgacguagacugcuggugcaacacgaccuccacaugggugguuuacggcacaugccaccacaagaaaggcgaagcccgacgaagccgacgugcagugacacucccaucgcacuccacacgaaaacuacaaacacgaucucaaacauggcuagaaucccgcgaauacacaaaacaccuaauacggguggaaaacuggauauucagaaaccccggcuucgcccuagcagcagccgcaauagcauggcucuuagggagcuccaccucacaaaaagucaucuaccucguaaugaucuuacuaauagcgccggccuacagcauacgcugcauagggguaagcaaccgagacuucgucgaaggaaugagcggaggcaccuggguagauaucguacuagagcacggcggcugcgucacuguaauggcacaagacaaaccuacaguagacaucgaauugguaacaacaacagucagcaacauggccgaagucagaucauacugcuacgaagcgagcauaagcgacauggcaucugacagccgcugccccacccagggcgaagccuaccucgacaaacagucagacacccaauacguaugcaaaagaacacucguagaccgaggauggggcaauggaugcggacucuucgggaaaggaagccuagucacaugcgccaaauuugcaugcucaaagaaaaugacaggaaaaucgauccaaccagaaaacuuagaauaucgaaucaugcugagcguacacggcagccaacacagcggcaugauagucaacgacacuggacacgaaaccgacgaaaaccgggcaaaagucgaaaucaccccaaacucaccaagggccgaagcaacacucggcggcuuuggaagccuaggccucgacugcgaaccccgcaccggacuagacuucucagaccuauacuaccuaaccaugaacaacaaacacuggcuaguucacaaggaaugguuccacgacauaccccucccauggcacgccggcgcagacacaggaacgccccacuggaacaacaaagaagcacucguagaguucaaggacgcccacgccaagcggcagacaguagucgugcucggaucacaagaaggagccguccacacagcccucgccggagcccuugaagcggaaauggacggcgcaaaaggacggcugucuaguggacaccuaaaaugucggcugaaaauggacaaacugcgucuaaaagguguaagcuacagccuaugcacagcagcguucaccuucaccaaaaucccggcagaaacgcuccacggaaccgucacaguagaaguacaauacgcagggacagacggcccaugcaaaguacccgcccaaauggccguagacaugcaaacacuaacaccagucggaagacucauaacagccaaccccguaaucacagaaagcaccgagaacuccaaaaugaugcuggaacucgauccucccuucggcgacagcuauauagucauaggugucggugagaagaaaauaacacaccacuggcaccgcagcggcagcacaaucggaaaagccuucgaagcaaccguucggggagcgaaacgaauggccgucuuaggcgacacagcaugggacuucggcucuguaggcggagcacugaacagccuaggcaaaggaauccaccagauauucggcgcagccuucaaaucacucuucggcgggaugucuugguucucacaaauacucauaggaacacuccucauguggcuaggcuuaaacaccaaaaacggaucgaucucgcugaugugccuagcacucggcggagugcugauauuccuaucgaccgcaguaucggccgacugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9436 - RNA, 2314 nt, Artificial Sequence
  ZIKV prME variant mRNA Design 3 opt
gggagaaagcuuaccaugaagaaacgccgcggcgccgacaccagcguaggaaucgucggacuacuguugacaaccgcaauggccgcggaagugacacgaaggggaagcgccuacuacauguaccucgacagaaacgacgccggagaagccauauccuucccgaccacacuaggcaugaacaaaugcuacauacaaauaauggacuuaggccauaugugcgacgcaacgaugucauacgaaugcccuaugcuagacgaaggaguggaacccgacgacgucgacugcuggugcaacacgacaucgaccuggguagucuacggcacuugccaccacaagaaaggagaagcacgacgaagccgacgggcagucacgcuacccagccacuccacccgaaaacuccaaacucgcagccaaaccuggcucgaaagccgcgaauacaccaagcaccuaauacgagucgaaaacuggauauuccggaacccaggcuucgcccucgcagcagcagcaauagccuggcuccuuggaagcuccacaucccaaaaaguaauauaccuagucaugauacuccuaaucgcccccgcauacagcauccgauguaucggaguauccaaccgcgacuucgucgagggcaugagcggcggcaccuggguagacauaguccucgaacacggaggcugcgucacaguaauggcccaagacaaacccacaguagacaucgagcuggucaccacaacgguaagcaacauggccgaaguccgauccuacugcuacgaagcaagcauaucagacauggcaucagacagcagaugccccacacaaggcgaagccuaccuagacaaacaaagcgacacacaauacguaugcaaacggacguuggucgaccggggcuggggcaacggaugcggucucuucggaaaaggcagccucguaaccugcgccaaauucgcgugcucaaagaaaaugacgggcaaaucaauccaaccggaaaaucuagaguaccggauaaugcuaagcguccacggaucacagcacuccggcaugaucgucaacgacaccggacacgaaacagacgaaaaccgugcaaaaguggagaucacaccaaacagcccccgcgccgaagccacacuaggcggauucggaucccugggacuagacugcgaaccaaggacaggacuagacuucuccgaccucuacuaccucacaaugaauaacaaacacuggcuaguacacaaagaaugguuccacgacaucccacuccccuggcacgccggagcagacacaggcacaccacacuggaacaacaaagaagcacucgucgaguucaaagacgcacaugccaaacgccaaaccgucguagugcuaggaucccaagaaggagcaguccacaccgcgcucgccggagcccuggaagccgaaauggacggagcaaaagggcgccugaguuccggccaccuaaagugccgccuaaagauggacaaacuaagacucaaaggcgucuccuacagccucugcaccgcagcguucaccuucacuaaaaucccggccgaaacacugcacggaacaguaaccguggaggugcaguacgcaggcacagacggacccugcaaagugccggcccaaauggcagucgauaugcaaacacuaacgcccguaggacgacucaucacagccaaccccguaaucacagaguccacagaaaacucaaaaaugaugcuagaacuagaucccccauucggagacagcuacauagucaucggcgucggugaaaagaaaauaacacaccauuggcacagaagcggcucaaccaucggaaaagccuucgaagccacgguccgaggggcaaaacgcauggccguccuaggggacacggcaugggacuucgggagcguagggggagcccucaacucccugggcaagggaauacaccaaauauucggcgccgcuuucaaaagccucuucggcgggaugagcugguucagccaaauccucaucggaacacuucucauguggcucggucuaaacaccaaaaacggaagcauaucgcugaugugccucgcgcuuggcggcguccuuauauuccuaucaaccgccguuuccgccgacugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9437 - RNA, 2311 nt, Artificial Sequence
  ZIKV prME variant mRNA Design 3 opt
gggagaaagcuuaccaugaagcgccgcggagccgacacaagcguaggaauugucggccuccuucuuacaacagcgauggcggccgaaguaacccgaagaggcuccgccuacuauauguaccucgacaggaacgacgccggcgaagcaaucucauuccccacaacccugggaaugaacaaaugcuacauccagauuauggaccuaggccacaugugcgaugccaccaugucguacgaaugccccaugcuagacgaaggaguagaaccagacgacguagacugcuggugcaacacaaccagcacaugggucguauacggaacaugccaccacaaaaagggcgaagcgcgaagaagccgccgcgcagugacccucccaagccacagcacacgaaaacuccaaacacgcagccaaacauggcucgaaagccgggaauacaccaaacaccucaucagggucgaaaacuggaucuuccgaaaccccggcuucgcacucgcugcagcagcaauagccuggcuucucggauccagcaccucccaaaaagucauauaccuagucaugauacuccuaauagcccccgcauacucuauacgcugcauaggagugaguaaccgagacuucguggaagggauguccggcggaacaugggucgacaucguccuagaacacgguggcugcguaacaguaauggcacaagacaaacccacaguggacaucgagcuuguaacaaccacaguauccaacauggcagaagucagauccuacugcuacgaagccuccauaucugacauggccucagacucacgaugcccaacccaaggagaagcauaccuagacaaacaaagcgacacacaauauguaugcaaaagaacauuagucgaccgcggauggggaaacggaugcggacuuuucggaaaagguucccuagugacuugcgccaaauucgccuguucgaagaaaaugaccggcaaguccauccaaccggaaaaccuggaauaccgaaucaugcuaucuguccacggcucgcaacacucaggcaugaucguaaacgacacgggccacgaaacagacgaaaacagagccaaagucgagauaacccccaacuccccucgcgccgaagccacgcucggcggauucggaagccugggccucgacugugaaccgcgaacaggacuagacuucagcgaccucuacuaccuaaccaugaacaacaagcacuggcuaguccacaaagaaugguuccacgacaucccacucccauggcacgcaggagccgacaccggaacaccacacuggaacaacaaggaagcccucgucgaguucaaagacgcgcacgccaaacgccaaacaguggucguccuaggaucccaagaaggcgccguccacaccgcacuagcgggagcccucgaagccgaaauggacggcgcaaaaggaagacucagcucgggccaccuaaaaugcagacuaaaaauggauaagcuccgacugaaaggaguaucuuacucccuaugcacagcagcauucaccuuuacuaaaauccccgcagaaacacugcacggaacaguaaccgucgagguacaauacgcaggcaccgacggacccugcaaaguaccggcccaaauggccgucgacaugcaaacccucacaccagucggaagacucaucacggcaaaccccguaaucaccgaauccaccgaaaacucuaaaaugaugcuggagcuagacccacccuucggcgacagcuacaucgucaucggagugggagagaagaagaucacccaccacuggcaccgaagcggcagcaccaucggcaaagcauucgaggcgacuguccgcggagcgaaaagaauggccguucucggggacaccgcaugggacuucggguccgucggcggcgccuuaaacagucucggaaaaggcauacaccaaauauucggcgccgcguucaaaagccuguucggaggcauguccugguucucgcaaauacuaaucggcacccuccuuauguggcucgggcuaaacaccaaaaacggaagcauaagccuaaugugccuagcccuaggcggcgugcucaucuuccuuagcacagccguaagcgcggacugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9438 - RNA, 2308 nt, Artificial Sequence
  ZIKV prME variant mRNA Design 3 opt
gggagaaagcuuaccaugagacggggcgcagacacaagcgucggaaucgucggacuccuacuuacgaccgcaauggcggcugaagucacacgccgaggauccgcauacuacauguaccucgaccguaacgacgcaggcgaagccauaucauucccuacaacgcugggaaugaacaaaugcuacauccagauaauggaccuaggccacaugugcgacgcaaccauguccuacgaaugcccaaugcucgacgaaggggucgaacccgacgacguagacugcuggugcaacacaacgagcacauggguaguguacggaacaugccaccacaaaaagggggaagcccgacgauccaggagagcagugacacucccaagccacagcacaagaaaacuacagacaagaucacaaaccuggcuugaaagcagagaauacacaaagcaccuaauacgaguugaaaacuggauauucagaaaccccggcuucgcacucgcagcagccgccauagccuggcuccugggcaguucaacgagccaaaaagucauauaccuaguaaugauacugcuaaucgccccagcauacucaauacgcugcaucggcguauccaaccgagacuucguagaaggaaugucaggaggaaccuggguagacauuguacucgaacacggaggaugcguaacagucauggcccaggacaaacccacggucgacaucgaacucguaacaacaaccguaucaaacauggcagaaguacgauccuacugcuacgaagcaagcaucucugacauggccucagacucacgaugccccacccagggcgaagccuaccuagacaaacagucggacacacaauacgucugcaaacgaacacuggucgaccgcgguuggggcaacggcugcggccuguucggaaaagggagccuagugaccugcgccaaauucgccugcagcaagaaaaugaccggcaaaucgauacaacccgaaaaccuugaguacagaaucaugcuauccguccacggcagccaacauuccggcaugauagucaacgacaccggccacgaaacagacgaaaacagagcaaaagucgaaaucacgcccaacuccccacgggcggaagccacacugggaggauucggcagccucggccuagauugcgaaccacgcacaggguuagacuucuccgaccucuacuaccuuacaaugaacaacaaacauuggcucgugcacaaagaaugguuccaugacaucccacuccccuggcaugcaggcgccgacacggggacaccacacuggaauaacaaggaggcgcuuguggaguucaaggaugcgcacgccaaacgacaaacaguaguuguccuaggcucacaagaaggcgcgguccacacagcccucgccggggcacuagaagccgaaauggacggcgccaaagggcgacucagcagcggccaccucaaaugccgacuaaaaauggacaaacugcgccuaaaaggggucagcuacagccucugcaccgccgcauucaccuucacaaaaauaccagccgaaacccuacacggcacagucacaguagaaguacaauacgccggcacagacggacccugcaaagucccagcccaaauggcggucgacaugcaaacccucacgccaguaggccgacuaaucacagcaaacccagucaucaccgagagcacagaaaacagcaaaaugaugcuagaacuggacccgccauuuggagauaguuacaucguaauuggcgugggggaaaagaaaauaacacaccacuggcacagaagcggcuccacaaucggaaaagcauucgaagcuaccguccgaggagcgaaacgaauggccguacucggcgacacagccugggacuucggcucaguaggcggagcccugaacucccucggcaaaggaauacaccaaaucuucggggccgcguucaaaucccuguucggaggaaugagcugguucucacagauacucauaggcacacuacuaauguggcuaggccuaaacacaaagaacggcagcauuagcuugaugugccuagccuugggaggcguacuaauauuccuaagcacagccguaucagccgacugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9439 - RNA, 2305 nt, Artificial Sequence
  ZIKV prME variant mRNA Design 3 opt
gggagaaagcuuaccaugcgaggagccgauacuucggucggcauagucggccuacuccuaaccacggccauggcugcagaagucacaagacggggcucagccuacuacauguaccucgacagaaacgaugcaggagaagcaaucucguuccccacaacacugggcaugaacaaaugcuauauacaaaucauggaucuuggccacaugugcgacgcaaccaugagcuacgagugcccaaugcucgacgaaggcgucgaacccgaugacguggacugcuggugcaacacaaccagcacaugggucguauacggaaccugccaccacaagaaaggcgaagcccgccgaucacggcgcgcagugacccuccccucacacuccacccgaaaacuacaaacaagaagccaaaccuggcucgaaucacgcgaguacaccaaacaccuaaucagaguagaaaacuggauauuccgcaacccaggcuucgcacuggccgccgcggcaauagcauggcuccuuggcucaagcacaucacaaaaaguaauuuaccucguaaugauacuacucaucgcccccgccuauagcauccgcugcaucggcgucucaaaucgcgacuucguagaaggcaugagcggcggaacauggguagacaucguccucgaacacggagguugcgucacggucauggcccaagacaaacccacaguagacaucgagcuagucaccacgacagucucuaacauggcugaaguacgaagcuauugcuacgaagcgaguaucuccgacauggcaucagacucacguugccccacccaaggagaggccuaccucgacaaacaauccgacacacaauacgucugcaaacgcacccucguagacagaggaugggggaacggcugcggacuguucggcaaaggaagccucguaacaugcgcaaaauucgcaugcucaaagaaaaugaccggaaaaucaauacaaccagaaaaccucgaauaccgcauaaugcuauccguacacggcucccaacacuccggaaugauaguaaacgacaccggccacgaaaccgacgagaaccgagcaaaagucgagaucaccccuaacuccccacgcgcagaagcaacccuaggcggcuucggcucccucggacuggacugcgaacccagaaccggacuggacuucucagaccucuacuaccucacaaugaacaacaaacacuggcucguucacaaggagugguuccacgacaucccccuccccuggcacgcaggcgcggacacagguacgccacacuggaacaauaaggaggcacucgucgaguucaaagacgcacacgcaaaacgccaaacugucgucguacugggcucccaagaaggagccguacacacagcccucgccggggcacucgaagccgaaauggacggcgccaagggacgacuaagcuccggccaccucaaaugccgacuaaaaauggacaagcuacggcucaaaggcgucucguacagccucugcacagcggccuucaccuucaccaaaauccccgccgaaacucuacacggcacagucaccguagaaguccaguacgcaggaaccgacggccccugcaaggugccagcacaaauggccguagauaugcaaacccuuacccccguaggccgccucauuaccgccaaccccgugauaaccgagagcaccgaaaacagcaaaaugaugcuagaacucgaucccccauucggcgacaguuacaucgucaucggcgucggagagaagaaaaucacacaccacuggcacagauccgguucaacaauaggaaaagccuucgaagcaaccguccgcggagccaaacgcauggcaguacucggcgacaccgcaugggacuucggauccgucggaggagcccuaaacucccucggcaagggaauacaccaaaucuucggcgccgccuucaaaagccucuucgguggaaugucaugguucagccaaauccugaucgggacacuucuaauguggcuuggccuaaacaccaaaaacggcagcaucagucucaugugucuagcccucggcggaguacucauauuccuaucaacagcaguauccgccgacugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9440 - RNA, 2302 nt, Artificial Sequence
  ZIKV prME variant mRNA Design 3 opt
gggagaaagcuuaccaugggggcggauaccuccguaggaauagucggacuacuacucacuaccgcaauggccgcagagguaacacgacgcggcagcgccuacuacauguaccuagaccgaaacgacgcaggagaagcaaucagcuuccccacgacacugggaaugaacaagugcuacauacagaucauggaccucggccacaugugcgacgcaaccaugagcuacgaaugcccaaugcuagacgaaggaguagaacccgacgacguagacuguugguguaacaccacaagcaccugggucgucuacggaacaugccaccacaagaagggagaggcccgccgcagcagacgagccguaacacuacccucgcacagcaccagaaaacuacagaccagaagccaaacauggcuagaaagcagagaauacacaaaacaccuaauccggguagaaaacuggauauuuaggaacccgggauucgcacuagcagccgcagcaauagcauggcuacuagggagcucaaccucccaaaaaguaauauaccuagucaugauccuacucaucgcgccagcauacuccauccggugcauaggaguaucaaacagagauuucguagaaggcaugucagggggcaccuggguagacauaguccucgaacacggagggugcguaacggugauggcacaagauaaaccaaccguagacaucgagcuaguaacaacaacagucagcaacauggccgaaguaaggucguacugcuacgaagccaguaucucagacauggccagcgacucacgaugcccaacccaaggagaagccuaccuagacaaacaguccgacacacaguacguaugcaaacgcacgcucgucgaccgaggcuggggaaacggcugcggccuguucggaaaagggagccuggucacaugcgcaaaauucgccugcuccaagaaaaugaccggaaaauccauacaacccgaaaaccuagaauaccggaucaugcucaguguccacggcagucagcauagcggcaugaucguaaacgacaccggacacgaaacagaugaaaaccgagcaaaagucgaaauaaccccaaacucgccccgagcagaagccacauuaggcggcuucggaucccuaggacuagacugcgaaccccgaaccggacucgacuucucagaccuguauuaucucacgaugaacaacaaacacuggcugguacacaaggaaugguuccacgacauaccacuaccauggcacgcuggagcugacaccggaacaccacacuggaacaacaaagaggcccuaguagaguucaaagaugcacaugccaaacgccaaaccgugguaguccuagggucccaagaaggagccgugcacaccgcacucgccggcgcacuggaagcagaaauggacggagccaaagggcgacuaagcuccggccaccuaaaaugcagacucaaaauggacaaauuacgacuuaaaggcguaagcuauucacugugcacggcggcauucacauucaccaaaauacccgccgaaacccuacacggaacagucaccguagaaguccaauacgccgggacagacggaccgugcaaagucccagcccaaauggccguagacaugcaaacacucacccccguaggaagacucauaaccgcaaacccggucaucaccgaaucaaccgaaaacagcaaaaugaugcucgaacuagacccgcccuucggggacagcuauauagugauaggcguaggagaaaagaaaauaacgcaccacuggcaccgaagcggcagcacaauagggaaagccuucgaagccacaguacgaggagcgaaaagaauggcaguccugggagacaccgcgugggacuucggaucgguaggaggcgcacuaaacagccugggaaaaggaauacaccaaaucuucggcgccgccuucaaaucacucuucggcggaaugucaugguucucccagauacuaaucgggacccuccugauguggcuaggucuaaacaccaaaaauggcucaaucucacuaaugugccuagcgcuaggaggcguccucaucuuccuguccacagccguaucggccgacugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9441 - RNA, 2299 nt, Artificial Sequence
  ZIKV prME variant mRNA Design 3 opt
gggagaaagcuuaccauggcagacaccaguguaggcaucguaggacuccuacuaaccacagcaauggccgcugaagucacacgacgcggaagcgcauacuacauguaccuagaccguaacgacgccggcgaagcaaucucguuccccacgacccucggaaugaacaaaugcuacauucaaauuauggaccuagggcacaugugcgacgcgacaaugagcuacgaaugccccaugcucgacgaaggcguggaaccagacgacgucgacugcuggugcaacacaacaagcacauggguggucuauggaaccugccaucacaagaaaggcgaagcacgaagaagccgccgggcaguaacacuuccgagucacagcacccgaaaacuccaaacacgcagccaaacauggcuagaaagccgcgaauauacgaaacaccuaaucagaguagaaaacuggauauuccgaaacccuggcuuugcacucgccgcagcagccauagcauggcuccugggcagcagcacaagccaaaaagucaucuaccuagucaugauacuccuuaucgcccccgcauacucaauccgcugcaucggcgucucgaacagggacuucguggagggcaugagugggggaaccuggguagacaucguccuagaacacggcggcugcgucacgguaauggcacaggacaaaccaacaguagauauagagcuaguaaccacuacaguauccaacauggcagaaguccgcagcuacugcuacgaagcaucgauaucggacauggccagcgauuccagaugcccaacccaaggggaggccuaccucgacaaacaaagcgacacccaguacguaugcaaaagaacacucguggacagaggguggggcaacggcugcggacuauucggcaagggaucacugguaaccugcgccaaauucgccugcuccaagaaaaugaccggcaaaagcauacagccagaaaaccuagaauacagaaucaugcucuccguacacggcucgcaacacagcggaaugaucguaaacgacacaggacacgaaacagacgaaaaccgcgcaaaagucgaaaucaccccgaacuccccgcgcgcagaagcaacacuaggcggcuucggaagccucggacuagacugcgaaccucgaaccggccucgacuucagugaccucuacuaccucacaaugaacaacaaacacuggcuaguacacaaagaaugguuccacgacaucccccuacccuggcacgcgggcgcagacacaggcacaccacacuggaacaacaaagaagcccugguggaguucaaggacgcccacgcaaaacgacaaaccgucgucguacuugggagucaagaaggcgcaguacacacagcacucgccggagcacucgaagccgaaauggacggugccaaaggacgccugagcagcggccaccucaagugcagacuaaagauggacaaacuaagacucaaaggagugagcuacagccuuugcaccgcagccuucaccuucacaaaaauaccggccgaaacccugcacggaacggucaccguagaaguccaguacgccggaacugacggacccugcaaggucccagcacaaauggcgguagacaugcaaacccuaacaccaguagggagauuaauaaccgccaaccccguaaucacagaaagcacggaaaacagcaagaugaugcuagaacucgacccgcccuucggggacagcuacauaguaauaggagucggagaaaagaagaucacccaccacuggcaccgaagcgggagcaccaucgguaaagcguucgaagcaacaguacgcggcgccaaacgcauggccguacucggugacaccgccugggacuucggcucggucggcggggcccucaauagccuuggcaaaggcauucaccaaaucuucggcgccgcauucaaaagccuauucggcggaaugagcugguucagccagauacucauagguacacuucuaauguggcucgggcucaacaccaaaaacggcucaaucagccuaaugugccuggcccucggaggagugcuaaucuuccuaagcacagccgucagcgccgacugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9442 - RNA, 2296 nt, Artificial Sequence
  ZIKV prME variant mRNA Design 3 opt
gggagaaagcuuaccauggacacaagcgucggcaucguaggacuacuacucacaacagccauggcagcugaagucaccagacgcggcuccgcauacuacauguacuuagaccgcaacgacgccggcgaagccaucucauucccaacaacacugggaaugaacaaaugcuacauccaaaucauggaccucggacacaugugcgacgcaacgaugucauaugagugcccuaugcuggacgaaggagucgaaccagacgacguagacugcuggugcaacaccacgagcacgugggucguauacggcacuugccaccacaagaaaggggaagcccgccgcucacgccgagccguaacccuaccaucccacucaacccggaaacuacaaacacgcucccaaacauggcuagaaagcagagaguacacaaaacaccugauacgcgucgaaaacuggauauuccgaaaccccggauucgcccucgccgcugccgccauagccuggcuccugggcagcuccaccucacagaaagucaucuaucucguaaugauccuacucaucgcccccgcauacagcauacgaugcauaggcgucucaaaccgcgacuucgucgaaggaauguccggaggcaccuggguugauaucguccuagaacacgguggaugcguaaccgucauggcacaagauaaacccaccgucgacaucgaacucguaacaaccacagucucgaacauggccgaaguacgauccuacugcuacgaagccagcaucucggacauggccuccgacagccgcugccccacccaaggcgaagcauaccucgacaaacaaagcgacacucaauacguaugcaagcggacacuuguagaccgaggcugggggaacggcugcggacucuucggcaaaggcagccuuguaacgugcgcaaaguucgccugcucaaagaaaaugaccggaaaauccauacaacccgaaaaccuugaauaccgaauaaugcuaagcguccacggaucgcaacauuccggaaugaucgucaacgauaccggccacgaaaccgacgaaaaccgagcaaaagucgaaaucacacccaacagcccccgcgcagaagccacccuagggggcuucggaagccucggacuagacugcgaaccgcgcacaggccucgacuucagcgaccuguacuaccucaccaugaacaauaaacacuggcuaguccauaaagagugguuccacgauauccccuuaccauggcacgcaggagcagacaccggcaccccacacuggaacaacaaagaggcacucgucgaguucaaagacgcacacgccaaacgccaaaccgucgucguacucggcucacaagaaggcgccguccauacagcccuggcgggagcccuagaagcagaaauggacggagccaaaggcagacuaagcucgggccaccucaaaugccgccuaaaaauggacaaacucagacucaaaggaguaagcuacucuuuaugcaccgccgcguucacauucacaaaaauucccgcagaaacccuccacggaacaguaaccguagaaguacaauacgccggcaccgacggccccugcaaagucccggcccagauggccguugacaugcaaacccuaacacccgucggcagacuaauaaccgccaacccaguaaucaccgaauccacggaaaacucaaaaaugauguuagagcuagauccaccguucggagacagcuacaucgugaucggcgucggcgaaaagaaaauaacccaccacuggcaccgcagcggaagcaccauaggcaaagccuucgaagccaccguccgaggggcgaaacgcauggcgguccuaggagacacagcuugggacuucggcagcguaggcggagcgcuaaacucacucggcaaaggcauccaccaaaucuucggcgcggcauucaaaucguuguucggaggaaugucaugguucucacagauacucaucggcacacuccugauguggcuaggccucaacaccaaaaauggcucaauaagccuaaugugccuagcacucggcggcguccuaaucuuccugagcacagccgucagcgcugacugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9443 - RNA, 2293 nt, Artificial Sequence
  ZIKV prME variant mRNA Design 3 opt
gggagaaagcuuaccaugacaagcguaggaauugucggacuccuacuaacaaccgcgauggcagcagaaguaacgcgacgcggcucagccuacuacauguaccuagaccgaaacgacgccggagaagccaucucauucccgaccacacucgggaugaauaaauguuacauacaaauuauggaccuaggccacaugugcgacgcaaccaugucguacgaaugcccgaugcucgacgagggagucgaaccggacgacguagacugcuggugcaacaccacguccacaugggucgucuacgggaccugccaccacaagaaaggagaagcacgacgaagccgacgggcgguuacccuaccaagccacagcacacgcaaacuccaaacacgcagucaaaccuggcucgaaucccgagaauacaccaaacaccuaauacgcgucgagaacuggaucuucaggaauccaggauucgcccucgcagcagcagccaucgcauggcuccugggcucgagcacuagccaaaaaguaauauacuuaguaaugauccuacugaucgcccccgcauacucaauacgaugcaucggcguaagcaaccgcgacuucgucgaaggcaugucaggaggaacauggguagacauaguccucgaacacgggggcugcgucacgguaauggcacaggacaaaccaacagucgacauagagcuagugaccaccacagucaguaacauggcggaaguccgaucguacugcuacgaagccagcauaucagacauggccucagacucacgcugccccacacagggagaggccuaccucgacaagcaaagcgacacacaauaugucugcaaaagaacauuagucgaucgcggguggggcaacgggugcggccucuucggcaaaggcagucucguaacaugcgcaaaauuugcaugcuccaagaaaaugacaggaaaauccauacaacccgaaaaucucgaguacagaaucaugcuauccguccacggcucccaacauagcgggaugauagugaacgacacgggccacgaaacagacgaaaaccgagccaaagucgaaauaacacccaacaguccccgcgcagaagcaacacuaggcggguucggcagccuaggcuuagacugcgaaccacgcacaggcuuagacuucagcgaccuauacuaccucaccaugaacaacaaacacuggcugguccacaaagagugguuccacgacaucccacuccccuggcaugcaggagcugacacgggcaccccacacuggaacaacaaagaggcucucguagaguucaaagacgcacacgcaaaacgacaaacagucgugguccuaggcucacaagaaggagcgguacauaccgcacuagccggagcccucgaggccgaaauggacggagcgaaggggcgccuaagcucaggacaccuaaagugccgacuuaaaauggacaaacuacgauugaaaggagucuccuacucccucugcacagcagccuuuacauuuaccaaaauaccggccgagacccugcacgggacuguaacaguugagguacaauacgccgggaccgacggcccaugcaaaguaccagcccaaauggcaguagacaugcagacccuaacccccguagggcgccugauaaccgccaauccagucaucacagaaucaacggaaaacucaaaaaugaugcuagaacuagaucccccauucggcgacagcuacauagucauaggagucggagaaaagaaaauaacccaccacuggcacaggucaggcucaacaaucggaaaagcauucgaagccacgguacgaggcgcgaaaagaauggcgguccucggcgacacugcaugggacuucggauccguaggcggcgcccucaacucacucggaaaaggaauccaccaaaucuucggcgccgcauucaaaucacuguucggcgggauguccugguucagccaaauacucaucggaacgcuacuaauguggcuaggccuaaacaccaagaacgggagcaucucccugaugugccucgcccuaggaggaguacugauauuccugagcacagccguaagcgccgacugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9444 - RNA, 2293 nt, Artificial Sequence
  ZIKV prME variant mRNA Design 3 opt
gggagaaagcuuaccaugaccuccgucggcaucguaggacuccuccuaacaaccgccauggcagccgcaguuacacgacgaggaagcgccuacuacauguaccuagacagaaacgacgccggagaagccauauccuucccgacgaccuuaggcaugaacaaaugcuacauacaaauaauggaccuaggacacaugugcgacgcaacgaugucauaugaaugccccaugcucgacgaaggaguggaaccugacgacguagacugcuggugcaacacgacaucaaccuggguaguauacggaaccugccaccacaagaaaggcgaagcccgacguucccggcgagccguaacccuccccagccacuccacacgcaaacuacagacacgaucacaaaccuggcuagagucacgagaauacacaaaacaccugauacgcguagagaacuggaucuuccgcaaccccggauucgcacuagccgccgcugccaucgcauggcuacuaggcagcucgaccucacaaaaaguaauauaccucguaaugauccuccuaaucgccccagccuacuccauacgcugcaucggggucucaaaccgcgacuuugucgaaggcauguccggaggaaccugggucgacauaguacucgaacacggcggcuguguaaccguaauggcacaagacaagccuacaguagacaucgagcuagucacaacaacaguaucaaacauggccgaaguacgcuccuacugcuacgaagcaagcauaagcgacauggcaagcgacagccggugccccacacaaggcgaagccuaucuugacaaacagagcgacacacaauacgucugcaaaaggacccucguagacagaggcuggggcaacggcugcggacuauucggaaaagggucacucgucacaugcgcaaaauucgccugcaguaagaagaugaccgggaaaagcauccaacccgaaaaccuagaauaccguaucaugcucagcguacacggcucacaacacuccggcaugauugucaaugacaccggucacgaaacagacgagaaccgcgcaaaaguggaaauaacccccaacucgcccagggccgaagcgacacucggaggauucggaucccuuggccuagacugcgaacccaggacaggacucgacuucucagaccucuacuaccuuaccaugaacaacaaacacuggcucguacacaaagaaugguuucacgacaucccccuaccauggcacgcgggagccgacacaggcacaccacacuggaacaacaaagaagcccuagucgaauuuaaggacgcacacgcaaaaagacaaaccguaguuguccuaggaucacaagaaggcgcaguacacacggcccucgccggagcccucgaagccgaaauggacggcgccaaaggccgacuaagcagcggccaccucaaaugccgccugaaaauggacaaacuccgacuaaaaggugucaguuauucccuaugcacagccgccuuuaccuucacaaaaauacccgcagaaacccuccacggcaccgucaccgucgagguccaauacgccggcacggacggccccugcaagguacccgcacaaauggccguggacaugcaaacccugacccccgugggcagacucauaacagcaaacccagucauaacagaaagcacagaaaacuccaaaaugaugcucgaacuagacccgcccuucggggacucauacauaguaauaggcguaggagagaagaaaaucacccaccacuggcaccgaucgggaucuaccaucggcaaagcauucgaagccaccgugcgaggcgccaaacgaauggcaguccucggcgacaccgcaugggacuuuggcucugucggaggagcccuaaacagccucggcaaaggcauccaccaaaucuucggugcagcguucaaaagccucuucggcggcauguccugguucagccaaauccugaucgggacccuacucauguggcuaggccucaauaccaaaaacggauccaucagccuaaugugccuggcccuaggcggaguccugaucuuccucucaacagcagucagcgcagacugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9445 - RNA, 2305 nt, Artificial Sequence
  ZIKV prME variant mRNA Design 3 opt
gggagaaagcuuaccaugcgaggcgcggacacgucagucggcauagucggucuacuacuuacaaccgccauggcagccgccguuacacgccggggauccgccuacuacauguaccucgaccgcaacgacgccggcgaagcaaucucguucccaaccacacuaggcaugaacaaaugcuacauccaaauuauggaccuaggacacaugugcgacgccaccaugagcuacgagugcccaaugcuagacgaaggaguggagccagacgacguggacugcuggugcaacacuacaucgaccugggucgucuacgggaccugccaccacaagaaaggagaagcacgaaggucaagacgagcuguaacacuaccaagccacuccacaaggaaauuacagacccgaagccaaacauggcucgaauccagggaauacaccaaacaucucauucgcguagaaaacuggauauuccgcaacccaggcuucgcacuagcggcggccgcgauagcuuggcuccucgggagcuccaccucgcaaaaaguaaucuaccuagucaugauccuacucauagcucccgcguacagcaucagaugcaucggcguaagcaaccgcgacuucgucgaaggcaugagcggcggcaccuggguagacauaguacucgaacacgggggcugugucaccguaauggcacaagacaaaccaacgguggauaucgagcuagucacaacgaccgucuccaacauggccgaaguaagaagcuauugcuacgaggcauccauaagcgacauggcaagcgacucgcgcugcccaacgcaaggugaagcauaccuagacaaacaaagcgacacacaauacguaugcaaacgcacccucgucgacagaggguggggcaauggaugcggacucuucggcaaaggcucccucgucacaugcgcaaaauucgccugcuccaaaaagaugacaggcaaaucaauccaacccgaaaaccuagaguaccgaauaaugcucagcguccacggaagccaacacagcggaaugauagucaacgacacaggacacgaaaccgacgaaaaccgcgcaaaagucgaaaucacaccaaacaguccaagagcggaagcaacacuaggcggauucggaucacuaggacuagauugcgagccacgcacaggacuagacuucagcgaccuauacuaccugacgaugaacaacaaacacuggcucguacacaaagagugguuccacgacaucccccucccauggcacgccggcgccgacaccggcaccccgcauuggaacaacaaagaagcccuaguagaguucaaagacgcacacgcaaagcgccaaaccgucgucguacuaggaagccaagaaggagcgguccacacagcccuagccggcgcccuagaagcugaaauggacggagcaaaaggaagacuaagcagcggucaccucaaaugcagacucaaaauggacaaacuacgccucaaaggcguaucguacucccucugcaccgccgccuucacauucaccaaaauaccagcagagacacuacacggaaccgugacaguggaaguccaauacgccggcaccgauggaccaugcaaaguacccgcacaaauggcaguagacaugcaaacccugacacccgucggcagacuaaucacagccaacccagucauaaccgaaagcaccgagaacagcaagaugaugcucgagcucgacccgccauucggggacagcuacaucgucauaggagugggagaaaagaaaaucacccaccacuggcaccgaagcggcucaacaauaggaaaagcguucgaagcgaccguccgaggagccaaacgcauggcaguacucggugacacagccugggacuucggcucaguaggcggcgcccuaaacucucuaggaaaaggcauacaccaaaucuuuggcgcagccuucaaaucacucuucggcggcaugagcugguucucccagauccuaauaggcacacuacuaauguggcucggacucaacaccaaaaauggcucgaucagccugaugugccucgcacuaggcggcguacugaucuuccuauccacagcgguaagcgccgacugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9446 - RNA, 2329 nt, Artificial Sequence
  ZIKV prME variant mRNA Design 3 opt
gggagaaagcuuaccaugcgcggccuaucgucacggaaaagacggagccacgacgugcuaacagugcaauuccucauacucggcaugcuacuaaugaccggaggcgucacccgccgaggcucagccuacuacauguaccuagacaggaacgacgccggggaagccauaaguuuccccacgacacugggcaugaacaaaugcuauauacaaaucauggaucuaggccacaugugcgacgccaccaugagcuacgaaugcccgaugcuagacgaaggagucgagccagacgacguggacuguuggugcaacacaacauccacauggguagucuacggaacaugccaccauaagaaaggagaagcccgacgcucaaggagagccgugacccucccaagccacucgaccagaaaacuccaaacaagaagccaaacguggcucgaaucgagggaauacacgaagcaccuaauaagagucgaaaacuggauauuccgaaacccaggauucgcacuggccgcggccgccaucgccuggcuacucggaagcagcacgagccaaaaaguaauuuaucuuguaaugaucuugcugauagccccggccuacagcauccgaugcaucggcguuucgaauagagacuucguagaaggcaugagcggcgguaccuggguagauaucguccucgaacacgggggaugcgugaccguaauggcccaggacaaaccgaccgucgacauagagcuaguaaccacaacagucagcaacauggcagaagucaggaguuacugcuaugaagcaucaauaucagacauggcaagcgacagcagaugcccuacacaaggggaggcauaccucgacaaacaaagugacacccaauacgucuguaaaagaacccuagucgaccgcggaugggggaauggcugcggacuauucggaaaagggagccuagugacaugcgccaaauucgcaugcucaaagaaaaugacaggaaaaagcauccaaccagaaaaccucgaguacagaauaaugcucagcguccacgggucacagcacagcggcaugauaguaaacgacaccggacacgaaaccgacgaaaaccgagccaaaguagaaauaaccccuaauagccccagagcugaggcaacccuaggaggcuucggcagcuugggacucgacugcgaaccccgaacgggacucgacuucuccgaccuauacuaccucaccaugaacaacaaacacuggcucgugcacaaagaaugguuccacgacaucccccugcccuggcacgccggcgccgacacaggaacgccucacuggaacaacaaggaagcccuuguagaguucaaagacgcgcacgcaaaacgccaaacgguggucgugcucggaagucaagaaggagccgugcacacggcacuagccggcgcgcucgaagccgaaauggacggagcaaaggggcgacugagcagcggacaccugaaaugccggcugaaaauggacaaacugagacuaaaaggagucagcuacagccuaugcaccgccgcauucacauucacaaaaauaccggccgaaacacuacacgguacagucacgguagaaguccaauacgcggggacagacggacccugcaaagucccagcgcaaauggcgguagauaugcagacacucacacccguggguagauuaauaacagcaaaccccgucaucacagaaagcacggaaaacagcaaaaugaugcuagaacuagacccacccuucggagauucauacauagucauaggcguaggcgaaaagaaaauaacccaccacuggcaccgcagcggcagcacaaucggaaaagcauucgaagcaacggugaggggagccaaacgaauggcgguccucggagauacagccugggacuucggaagugucgggggugcacugaacagccuaggcaaaggcauacaccaaaucuucggagcagcguucaaaagccucuucgggggaaugagcugguucucccaaauauugauaggaacucuacucauguggcucgggcuaaacacuaaaaauggcagcaucagccucaugugccuggcccucggaggcguccucauauuccuaagcacagccgucagcgccgacugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9447 - RNA, 2329 nt, Artificial Sequence
  ZIKV prME variant mRNA Design 3 opt
gggagaaagcuuaccaugcgaggccuuagcucccgcaaacgacgcagccacgacguacuaaccguccaauuccuaauacuaggcaugcuccucaugacaggcgccguaacaagacgggguuccgcauacuacauguaccucgacaggaacgacgcgggagaagccauuuccuucccaaccacacucggcaugaacaaaugcuacauacaaauaauggaucucggacacaugugcgacgccaccaugucauacgaaugcccaaugcuagacgaaggaguggaacccgacgacguagacugcuggugcaacaccacauccaccuggguagucuacggaacgugccaccacaagaaaggagaagcacggcgaagccgacgagccguaacccuccccucccacagcacucgcaaacuccaaacacgaucacaaacauggcuagaaucccgcgaauacaccaaacaccuaauacgcgucgaaaacuggaucuuucgaaacccaggcuucgcccucgcagcagccgcgauagcauggcuucuuggaagcagcacaagucaaaaaguaaucuacuuaguaaugauccugcuuauagcgccugcauauucgauacggugcaucgggguaagcaaccgcgacuucgucgaaggaaugucaggaggcaccuggguagacauuguacucgaacacggaggaugcguaaccguaauggcccaagacaaaccuacagucgacauagagcucguaacgaccacaguaagcaacauggcagagguccgaucauacugcuacgaagccucaauaagugacauggccucagacucacgcugcccaacccaaggcgaggccuaccuagacaagcaauccgacacacaguacgucugcaaacgcacacucgucgacagaggguggggcaacgguugcggccuuuucggcaaaggaucacucguaacaugcgcaaaauucgccugcuccaagaaaaugacuggaaaaagcauacaaccagaaaaccuagaguacagaauaaugcuauccguacacgggagccagcacucaggaaugaucgucaacgacacgggacacgaaaccgacgaaaaccgcgcaaaaguagaaauaacacccaacucaccccgagcagaagcgacccuaggaggauucggaucccucggacuagacugugaacccagaacaggccucgacuucagcgaccucuacuaccucaccaugaacaacaaacacuggcuuguccacaaagagugguuccacgacaucccccuacccuggcacgccggagcagacaccggcaccccacacuggaacaacaaagaagcccucgucgaguucaaagacgcgcacgcaaaacgacaaaccgucgucguucuuggaucccaggaaggagccguccauacagcacuagcaggcgcccuggaagccgaaauggacggcgccaaggggcggcuaucaucaggccaccuaaaaugucgccuaaagauggacaaacuccgacuaaaaggggucucauacucucuaugcaccgcggcauucaccuucaccaagauccccgcagaaacccuacacggaaccgucacaguagaaguacaauacgccggcacagacggccccugcaaggucccagcccaaauggccguagacaugcaaacacugaccccaguaggacgacuaauaaccgcgaaccccguaauaaccgaaucgaccgaaaacucaaaaaugaugcucgaacuagacccaccguuuggcgacagcuacaucgucaucggcgucggagagaaaaagauaacccaccacuggcacagguccggaagcaccaucgguaaggcuuucgaagcaaccguccgcggagccaaacgcauggccguccuaggagacacagcaugggauuucggcagcgucggcggagcccugaacagccucggaaaaggaauacaccaaauauucggagccgcguucaaaagccuauucgggggcauguccugguucucacaaauccuaaucggcacacuacugauguggcucggccucaacaccaaaaacgggagcauuagccucaugugucuagcucuaggcggcguacuaaucuuccuauccacagcagugagcgcggacugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9448 - RNA, 2335 nt, Artificial Sequence
  ZIKV prME variant mRNA Design 3 opt
gggagaaagcuuaccaugcgcaucauaaacgccagaaaagaaaagaaacgaaggggagccgacacaucaguaggcaucgucggacuacucuugaccaccgcaauggccgcggaagucaccagaaggggcucagcauacuacauguaccuagaccguaacgacgccggagaagcaaucuccuuccccaccacccuuggaaugaacaaaugcuacauacaaauaauggaucuaggccauaugugcgacgccaccauguccuacgaaugccccaugcucgacgaaggaguagagcccgacgacguggacuguugguguaauaccaccagcacaugggucgucuaugggaccugccaccacaagaaaggcgaagcacgaagaagucgacgagcaguaacacuaccgagccacagcacccgaaaacuacaaacaagaagucaaacauggcuagaaagccgagaauacacgaaacaccuaauaagaguagagaacuggauauucagaaacccaggguucgcccucgccgccgcggccaucgcauggcugcuaggcuccagcacaucgcaaaaaguaauauaccuagucaugauucuacuaaucgcacccgcauacagcauccgcugcauaggcgucucgaaccgcgacuucgucgagggcaugucaggaggcacauggguggacaucgucuuagaacacgguggaugcgucaccgucauggcccaagacaaacccaccguagacaucgagcugguaaccaccaccguauccaacauggccgaagugcgguccuacugcuacgaagccucaauaagcgacauggccuccgacagcagaugcccaacccaaggggaggcguaucucgacaaacaaagcgacacccaauacgucugcaaacgaacacucguagaccgcggguggggaaacggcugcggacucuucggaaaaggcagccucguaaccugugccaaauucgcaugcucgaagaaaaugaccggaaaauccauacaaccagagaacuuagaauaccgcaucaugcuaagcguacauggcagccaacacagcggcaugauaguaaacgacacaggccaugaaacagacgaaaaccgagcaaaagucgaaaucacccccaacagcccgagagcagaagccacacuaggaggauucggcagccuaggccuggacugcgaaccaaggacaggccucgacuucagcgaccucuacuaccucaccaugaacaacaagcacuggcuaguacacaaagaaugguuccacgacauaccacuccccuggcacgcaggcgccgacacagggacaccccauuggaauaacaaagaagcacugguagaguucaaagacgcccacgccaagagacaaaccguaguaguacuaggcucccaggaaggggcaguccacacagcacuagcgggagcacuggaagcagaaauggacggcgccaaagggcgacuaagcagcggccaccugaaaugcagacuuaaaauggauaaacuacgacuaaagggcgucagcuacagccucugcaccgcugccuucacauucacgaaaauccccgccgaaaccuuacacggcacggucacagucgaaguacaauacgccggaaccgacgguccaugcaaaguacccgcacaaauggccgucgacaugcagacacuaacacccgucggacggcuaauaacagccaaccccguuaucacagaaucgaccgaaaauucaaaaaugaugcucgaacuagacccaccguuuggagacuccuacaucguaaucggcgucggagaaaagaaaaucacacaccacuggcaccgcagcggcuccacgauagggaaagcauucgaggccaccguccgaggagcaaaaagaauggccguccucggcgacacagcaugggacuucggcagcgucggaggcgcgcucaacagucucggaaaaggcauccaccaaauauucggcgcagcauucaaaagccuuuucggcggcaugagcugguuuucacaaauccuaauaggaacccuccucauguggcucggccuaaacaccaaaaacgggucaauaagccuaaugugccuggcccucggcgggguccuaauauuccucuccacggcagucagcgcaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9449 - RNA, 2329 nt, Artificial Sequence
  ZIKV prME variant mRNA Design 3 opt
gggagaaagcuuaccaugauaaacgcccgaaaagagaaaaagcgccgaggagccgacacauccguagguauagucggccucuuauuaacaacagcaauggcugccgaaguaacaagacgcggcagcgcauauuacauguaccuugaccgaaacgaugcaggggaagcaauaucauuuccaacaacacuuggcaugaacaaaugcuauauccaaaucauggacuugggacacaugugcgacgccacaaugucauacgaaugcccgaugcuagacgaagggguggaaccggacgacguugacugcuggugcaacacaacuucaaccuggguagucuacggaaccugccaccacaagaaaggcgaagcaagaagauccagacgggccgucacacuccccagccacagcacuagaaaacuacaaacccgaagccaaacauggcucgaaagccgcgaauacacaaagcaucugauccgaguggaaaacuggaucuuccgaaaccccggcuucgcccucgccgccgcagccauagcauggcuccugggauccuccacgucacaaaaagugauauaccuaguaaugauccugcucauagccccggccuacuccauacgcugcauaggcguaagcaaccgagacuucguagagggaaugucagggggcaccugggucgacaucguccuagaacacgggggcugcgucacagucauggcgcaagacaagcccacagucgacaucgagcucgucacaacaaccguaucaaacauggcagagguaagguccuacugcuacgaagcgucaaucucagacauggccagcgacucccguugccccacacaaggcgaggccuaccuagacaaacaauccgacacacaauacguaugcaaacgaacacucguagaccggggcuggggaaacggcugcggacucuucggcaaaggcagccucgucacaugcgcgaaauucgccugcucaaagaaaaugaccggaaaaagcauccaacccgagaaccuagaauaccgaauaaugcuaagcguacacgggucccaacacuccggaaugaucgucaacgacaccggacacgaaaccgacgaaaacagagcuaaaguagaaaucacgccaaacucgccacgcgcagaagccacgcucggaggauucggaucacuagggcuagacugcgagccacgcaccgggcuagacuucuccgaccuauacuaccuaaccaugaacaacaaacacuggcuuguucacaaagaaugguuccaugacaucccccuccccuggcacgcaggagccgacacaggaaccccacacuggaacaacaaagaagcccuaguagaguucaaagacgcacaugcaaaacgccagaccgucgucguacuaggaucccaagaaggagcuguccauaccgcacucgccggcgcccucgaagccgaaauggacggagccaaagggcgccuaagcuccggacaccucaaaugccgacuaaaaauggacaaacuaagacugaaaggcgucagcuacagccuaugcacagccgcauucacauucaccaaaauuccagcagaaacgcuccacggaacagucaccguagaaguacaauacgccggcacagacggccccugcaaagugccagcccaaauggcgguagacaugcaaacacucacaccagucggccgccuaauaacggcuaacccaguaaucaccgaaagcaccgaaaauagcaaaaugaugcuugaacucgacccgcccuucggagacagcuacaucgucaucggcgucggggaaaagaaaauaacacaccacuggcaccgaagcggguccacaaucggcaaagccuucgaagcaaccguaaggggcgcaaaacgcauggccguacucggagacacggccugggacuucgguuccgucggaggcgcacuaaacagccugggcaaaggcauccaucaaaucuucggagcagcauucaaaucacuuuuugggggaaugagcugguucucccaaauccugaucggcaccuuacuaauguggcugggccuuaacaccaaaaauggcagcaucucgcucaugugccucgcacucggaggaguccuaaucuuccugagcacagccguauccgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9450 - RNA, 2332 nt, Artificial Sequence
  ZIKV prME variant mRNA Design 3 opt
gggagaaagcuuaccaugauaaucaacgcaagaaaggaaaagaaacgccgcggugccgacacaucaguaggcauagucggccuccuccucacgacagcuauggccgcagaaguaacacgacgcggaagcgcguacuacauguaccucgaccgcaacgacgccggagaagcgaucuccuucccgaccacacucggcaugaacaaaugcuacauccaaaucauggaucucggacacaugugcgacgccaccauguccuacgagugcccaaugcuagacgaaggagucgaacccgacgacguagauugcuggugcaacacgaccuccacaugggucguuuacggaaccugucaccacaagaagggcgaagcccgacgaagccgcagagcagucacccuacccagccacuccacucgcaaacuccagacacgaagccaaacauggcucgagagccgagaguacacaaaacaccucauaaggguagaaaacuggaucuuccgaaauccaggcuucgcccuagccgcagccgccaucgcguggcuucuaggcucaagcacgucacaaaaggucaucuaccucgucaugauccuacuaaucgcuccagccuauucaauccggugcauagguguaagcaaccgagacuucguagaaggcaugucaggaggaacauggguagacaucguccuggaacauggcggaugcguaaccgucauggcccaagacaaacccacaguagacaucgaacucgugaccaccaccguaagcaacauggcagaaguccgaagcuacugcuacgaggcuucaaucagcgacauggcaucagacagcagaugccccacacaaggcgaagccuaccuagacaagcagucagacacccaauauguaugcaaacgcacccuagucgauaggggauggggaaacggaugcggacucuucgguaaaggcagucucgugaccugcgcgaaauucgcgugcuccaagaaaaugacgggcaaaagcauucaacccgaaaaccuagaauacagaaucaugcuaucaguccacggcucccaacacuccggcaugauugucaacgacaccggccacgaaaccgacgaaaaccgagcaaaagucgaaaucacacccaacagcccgcgcgccgaagccacacucggcggcuucggcagccugggccucgacugugaaccccgcacaggacuagacuucagcgaccucuacuaccugacaaugaacaacaaacacuggcucguccacaaagaaugguuccacgacauuccccuccccuggcacgccggcgcagauaccggaaccccacacuggaacaauaaagaagcacucguagaguucaaggacgcgcacgcaaaacggcaaacagucgugguccugggcucgcaagaaggcgcaguccacacagcccucgccggcgcccuagaagccgaaauggacggagcaaaagguagacucagcucaggacaccuaaaaugcagacucaagauggacaaauuacgccucaaaggcguaucuuacucccuaugcaccgccgcauucaccuuuaccaaaaucccggcagaaacgcuccauggaacagucaccgucgagguccaauacgccggaaccgauggaccuugcaaaguccccgcccaaauggcgguugacaugcagacccugacccccgucggccgacucaucaccgccaacccagucaucacugaaagcacagaaaacuccaaaaugaugcucgaacucgacccacccuucggcgacaguuacauugucaucggcgucggggaaaagaagaucacacaccauuggcaccgguccggaagcacgauuggaaaggccuucgaagcaaccgucagaggagccaaaagaauggcgguacucggcgacaccgcaugggacuuuggcuccgucggcggagcacuuaacucacucggaaaaggcauacaccaaauauucggugcugccuucaaaucacucuucggcggcaugagcugguucucacagauacuaaucggaacacuacuaauguggcuaggccucaacaccaaaaacggaagcauaucacuuaugugccuagcccucggcggaguacuaaucuucuuguccacagcagucuccgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9451 - RNA, 2326 nt, Artificial Sequence
  ZIKV prME variant mRNA Design 3 opt
gggagaaagcuuaccaugaacgccagaaaagaaaagaaacgaagaggcgccgacaccagcguuggaaucgucggacuacuacuaaccaccgcgauggcagccgaagucacgagaaggggaagcgccuacuacauguaccuagacagaaacgacgcaggcgaggcaauaaguuuccccacaacgcuaggaaugaauaaauguuacauacaaauaauggaucucggacacaugugcgacgcaacaaugagcuacgaaugcccaaugcuagacgaaggagucgaaccagacgauguggacugcuggugcaacacaacuagcacaugggucgucuacggcacaugccaccacaagaaaggagaagcacgaaggagucgcagagccgucacgcuacccagccacucaacgagaaaacuccagaccaggagccaaacguggcuagagagcagagaauacacaaaacaccuaauaagagucgaaaacuggaucuuccgaaacccaggcuucgcccucgccgccgcagccauagccuggcuccuagguucuaguaccagccaaaaaguaauauaccuagugaugauccuacugauagcacccgcauacuccauccguugcauaggagucagcaaccgcgacuucguagaaggaaugagcggaggaaccugggucgauaucguacuagaacacggcggcugcgucacagucauggcccaagacaaaccaaccgucgacauagaacucgugacaacaacaguuagcaacauggcggaagugcgaagcuacugcuaugaagccuccauaucagacauggcaucggacagccgauguccaacacaaggagaagccuaccuagacaagcaauccgacacacaauacguaugcaaaagaacccuagucgaucgaggcuggggcaacgggugcggccuuuucggaaaaggaagccuggucacaugcgccaaauucgcgugcagcaagaaaaugacaggcaaaucaauccaaccagaaaaccucgaauaucgaaucaugcucucgguacacggcagccaacacuccggaaugaucguaaacgacacaggucacgagacagacgaaaacagagcaaaagucgaaaucacgcccaacagcccaagagccgaagcaacacucggcggguucgggagccuaggacuagacugcgaaccccgaacaggccucgacuucucggaccucuacuaucuuaccaugaacaacaaacacuggcuaguccacaaagaaugguuccacgacaucccccuccccuggcacgcaggggcagacaccggaacgccgcauuggaacaauaaagaggcucuagucgaguucaaggacgcacacgcgaaaagacaaaccgucgucguauuaggcucacaagagggcgccguccacacagcgcucgcaggggcacuagaagccgagauggacggcgcgaaaggaaggcuaucaucaggucaccucaaaugccggcuuaagauggacaaacugagacuaaaagggguauccuauucacucugcacagcagcauucacauucacaaaaauccccgcagaaacacugcacggaacaguaaccguagaaguccaauacgcaggcaccgacggcccaugcaaaguaccugcccaaauggccguagacaugcagacccuaacgcccgucggccggcucaucacggccaacccgguaauaacugaaucaacagaaaacucuaaaaugaugcuggaacuggacccacccuucggcgacaguuacauagucaucggugucggugaaaagaaaaucacccaccacuggcacagaagcggaagcacuauaggcaaagcguucgaagccacaguaagaggcgcaaaaaggauggcaguacuaggagacaccgccugggacuucggcucaguaggaggagcacuaaacucgcucggcaagggaauccaccaaauauucggagccgcauucaagagccuauucggcggaaugagcugguucucacaaauccuaaucggaacgcugcuaauguggcucggccuaaacacaaagaacggcagcaucagccuaaugugccucgcccucgggggcguccuuauauucuugagcacagcaguaagcgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9452 - RNA, 2323 nt, Artificial Sequence
  ZIKV prME variant mRNA Design 3 opt
gggagaaagcuuaccauggccaggaaagagaaaaagagaagaggcgcggacacaucaguaggaauagucggacuacugcuaacaaccgccauggcagcagaaguaacccgaagaggcucagccuacuacauguaccucgaccgaaacgacgccggagaagccauaucauuccccaccacccucggaaugaacaaaugcuacauccagaucauggaccucggccacaugugcgaugcaaccaugagcuacgaaugcccaaugcucgacgaaggcguagaaccagacgacguagacugcuggugcaacacaaccaguacguggguagucuauggcacaugccaccacaagaaaggcgaagcacgcagaagccgccgcgcagucacucucccaucucacagcaccagaaaacuccagacaaggagccagaccuggcuggaaucccgagaauacaccaaacaccuaauaagggucgaaaacuggauuuuccgcaacccaggcuucgcacucgcagccgcagccauagccuggcuacugggcagcagcacaagccaaaaagugaucuaucucgucaugauacuccugauugccccagcuuacuccaucagaugcaucggcguaagcaaccgagacuucgucgaggggaugucgggaggaaccuggguugacaucguacucgaacacggcggaugcguaaccguaauggcucaagacaaacccaccguugacauagaacuggugacaaccacaguauccaacauggcagaggugagaucauacugcuacgaggcuucaaucucugacauggccucggacagccgcugccccacacagggggaagcguaccucgacaaacaaucagacacacaguacgucugcaaacgaacccucguagaccgcggauggggcaacgggugcgggcuauucggcaaaggaucacucgucacaugcgcaaaauucgcuugcucgaagaaaaugacaggcaaaagcauacaaccagagaaccucgaauacagaauaaugcugucaguacacggcucacaacacagcggaaugauugucaacgacacaggacacgagaccgacgaaaacagggccaaaguagaaauaacccccaacagcccccgagccgaggcaacacuuggaggauucggcucccuaggauuagacugcgaaccgcgcaccggacuggacuuuagcgaccuauacuaccucacaaugaacaacaaacacuggcuaguccacaaagagugguuccacgacauaccccucccauggcaugccggagcagacacaggaaccccacacuggaacaacaaagaagcgcugguagaguucaaagacgcccacgcaaaacgccaaacagucgugguccucggcagccaagaaggcgccguccacaccgcacucgccggcgcacuagaagcagaaauggacggcgcgaaaggccggcucagcuccgggcaccuaaaauguagacuaaaaauggauaagcuacgccuaaaagggguaucauacagccuaugcaccgccgccuucacauucacaaaaauaccggcagaaacacugcacggaacaguaacagucgaaguacaauacgcaggaaccgauggcccaugcaaaguuccagcccaaauggcagucgacaugcaaacacugaccccggucggaagacuuaucacagcaaaccccgucaucacagaaucaaccgaaaacagcaaaaugaugcucgaacuagacccaccauucggcgacaguuacauagugauaggcguaggagagaagaaaaucacccaucacuggcacagauccgggagcacuauagggaaagccuucgaggccacaguaaggggagccaaacgcauggccguccucggugacacagcaugggacuucggcucaguaggcggcgcccucaacucccucggaaaaggaauccaccaaauauucggggccgcauucaagagccuguucgggggcaugagcugguucucccaaauccuaauaggcacccuccucauguggcuaggccucaauaccaaaaacggaaguaucucacucaugugccuagcacuaggcggcguccucauauuccucagcacagccguuagcgcgugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9453 - RNA, 2320 nt, Artificial Sequence
  ZIKV prME variant mRNA Design 3 opt
gggagaaagcuuaccaugcgaaaagagaagaaaagacgcggagcagacaccagcgucggaaucgucggccuucuccucacuacagccauggccgccgaagucacgagacgcggauccgcauacuacauguaucuagaccgaaacgacgccggcgaggcaaucucauuccccaccacccucggcaugaauaaaugcuauauccagauaauggaccucggccacaugugcgacgcaacaaugagcuacgaaugccccaugcucgacgagggaguagaacccgaugacguugacugcuggugcaacacaaccucgaccugggucguguacggcacaugccaccacaagaaaggagaagcgagacgcucccgucgagcaguaacccuuccaucccacagcacccggaaacuccaaacacgcucccaaaccuggcucgaaucccgcgaauauacaaaacaucuaauccgaguagaaaacuggaucuuccgcaacccgggauucgcccuggcagcggccgccaucgccuggcuacucgguagcuccaccagccaaaaaguaaucuaccucguuaugauacuacuaaucgccccagcauacucaauacgcugcaucggcguaagcaaccgagacuucgucgaaggaaugucaggcggcaccugggucgacaucguccuagaacacggcggaugcgucaccgucauggcgcaagacaaaccaaccguagacauagagcuaguaacaaccaccguaucaaacauggccgaaguccgaagcuacugcuacgaagcaucgauauccgacauggccuccgacucacgcugccccacccaaggagaagccuaccuagacaaacagucggauacgcaauacgucugcaaacgaacccuagucgaccgaggcuggggaaacggcugcggccucuucggaaaagggucccuaguaaccugcgcaaaauucgcaugcagcaagaaaaugacaggcaaguccauccagcccgaaaaccucgaauaucgaauaaugcucuccguccacggcucacaacacagcggaaugaucgucaacgacaccggacacgaaaccgacgaaaaccgagcaaaagucgagauaaccccaaacucaccucgcgcugaggcaacacucggaggcuucggcucccucggacucgacugcgaaccacgaaccgggcuagacuucagcgaucuauauuaccucaccaugaacaacaaacacuggcuaguccacaaagaaugguuccacgacauaccacuccccuggcacgccggcgcagacaccggcacgccccacuggaacaacaaagaagcccuggucgaguucaaagacgcccacgccaaacgucaaaccgucgugguacucgggucccaagaaggagcaguccacacagcacuugcgggcgcccuggaagccgaaauggacggcgccaaaggacgucucuccagcggacaccuaaagugccgccugaaaauggacaaacuacgacuaaagggagucucauacagcuuaugcaccgccgccuucacauuuaccaaaauacccgcagaaacgcuacacggcaccguaaccgucgaaguacaauacgcgggaacagacggacccugcaaaguaccugcucaaauggccguagacaugcaaacacucacaccagucggaagacuaaucacagcaaaccccguaaucaccgaaagcaccgaaaauuccaaaaugaugcucgaacuagacccaccguuuggagacucuuacaucguaauaggagugggcgaaaagaaaaucacacaucacuggcaccgaucgggaucgaccauagguaaagccuucgaagcaacagugcgaggcgccaaacgaauggcuguacuuggagacaccgcaugggauuuuggcuccguuggaggagcccuuaacagccucggcaaaggcauacaccagauuuucggcgcagccuucaaaucccucuucggcggcauguccugguucucccaaauccucaucggaacccuacucauguggcuaggccucaacacgaaaaacggaucaauaucccucaugugccuagcacugggcgguguacuaauauuccucuccaccgccgucucagcgugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9454 - RNA, 2317 nt, Artificial Sequence
  ZIKV prME variant mRNA Design 3 opt
gggagaaagcuuaccaugaaagagaaaaagaggagaggcgcggacacguccgucgguauaguaggccuacuucuaacaaccgccauggccgcagaaguaacccgucgaggaagcgccuacuacauguaccucgaccgaaacgacgccggcgaagcgaucagcuuccccaccacccucggcaugaacaaauguuacauccagauaauggaccucggccacaugugcgacgccacgaugucauacgaaugccccaugcuugacgaaggcguugaaccagacgacgucgacugcuggugcaacacuacaagcaccuggguggucuacggcacuugccaccacaaaaagggagaagcacgccgcagccgucgagccguaacccuucccucacacagcacccgaaagcuccaaacccgcucccaaaccuggcuagaaucucgagaauacaccaaacaccucauuagagucgaaaacuggauauuccgcaauccaggcuucgcccuagcagcagccgcaaucgccuggcuucucggauccucaacaucacagaaagucauauaccucguuaugauacuccuaaucgccccagccuacagcaucagaugcaucggcgucagcaaccgagacuucguagaaggcaugagcggaggaacauggguagacaucguccucgaacacggaggaugcgucaccguaauggcccaagacaaacccacaguugacauugagcuagucacaaccaccgugagcaacauggccgaagugcgcagcuacugcuacgaagccuccauaucagacauggcaucagacagccgcugcccuacacagggagaagcauaccuggacaaacaguccgacacacaauacgucugcaaacgaacccucguagaccgaggcuggggaaacggaugcggacuauucggcaaaggcucccucgucacaugcgcaaaguucgccugcagcaagaaaaugaccggcaaaucuauccagcccgagaaccucgaauacagaauaaugcucuccguacacggaucccaacacagcggcaugaucgucaacgacacaggacacgaaacugacgaaaaucgcgcgaaagucgaaaucacacccaacuccccucgagcggaagcuacccugggcggcuucggcagccuaggccucgauugcgaaccacgaacaggcuuagacuucuccgaccucuacuaccuaacgaugaacaauaaacacuggcuaguccacaaagaaugguuccacgacauaccguuaccguggcacgccggggccgauaccggaacaccacauuggaacaacaaagaagcacugguagaguucaaagacgcccacgcaaaacgccaaaccgucgucguacucgggucccaagaaggcgcaguccacacagcccucgcaggagcccucgaagccgaaauggacggcgcaaaaggccgccucagcaguggucaccuaaaaugcagacuaaaaauggacaaacuccgacuaaaaggcgucucguacucccuguguaccgcagcuuucacuuucaccaagauccccgcagaaacccuccacggcaccgucaccguagaagugcaauacgcagggaccgauggccccuguaaaguaccggcccaaauggcagucgacaugcagacccugacacccgugggccggcucaucacagcaaaccccguaauaacagaauccaccgaaaacuccaagaugaugcuagagcuagaucccccauucggcgacagcuacauagucaucggaguaggagaaaagaaaaucacacaccacuggcaccgguccggcuccaccauaggcaaagcauuugaagcuacaguccgcggcgccaaacgcauggcaguacuuggcgacaccgccugggacuucggcuccguaggaggggcgcucaacagccuagggaaaggaauccaccaaaucuuuggagccgcauucaaaucccuauucggcggcauguccugguucucucaaauccugaucggcacccuacucauguggcuaggccucaacaccaaaaacggcuccaucucccuaaugugccuggcacucggaggaguacucaucuuccuauccacagccgucuccgcaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9455 - RNA, 2314 nt, Artificial Sequence
  ZIKV prME variant mRNA Design 3 opt
gggagaaagcuuaccauggagaagaaaagaagaggagcagacaccagcguaggcaucguaggccuccuacucacaaccgcaauggccgccgaaguaacccgccggggcuccgcauacuacauguaccuagaccgcaaugaugccggcgaagcaauaucguuccccaccacccucggcaugaacaaaugcuacauacaaaucauggaccuaggacacaugugcgacgccaccauguccuacgaaugccccaugcuagacgaagggguugaacccgaugacgucgacugcuggugcaauacaacgagcaccugggugguuuacggaacgugccaccacaagaaaggggaggcccgccgcucccgcagagccguaacccuccccucacacagcaccagaaaacuacagacacgaagccagacauggcucgaaucacgagaauacaccaagcaccucauccgcguagaaaacuggauauuccgcaaccccggcuucgcccuagccgcagccgccaucgccuggcuccuuggcuccucaacaagccaaaaagucauauaccucgucaugauucuacucaucgcgcccgccuacuccauccguugcaucggagucuccaacagagacuucgucgaaggcaugucaggaggcaccuggguugacaucguccuugaacacggggguugcguaacggugauggcccaggacaaacccacaguagacauagaacuugugaccacaacuguauccaacauggcggaaguccgcucauacugcuacgaagccagcaucucggacauggccuccgacucccgaugcccaacacaaggcgaagcauaccucgacaaacaauccgacacccaauacgucugcaaacggacacucgucgaccgcggauggggaaacggcuguggucuauucggcaaaggaucccuagugaccugcgcaaaauuugcuugcucaaagaaaaugacgggaaaaucaauccagcccgaaaaccucgaauacagaaucaugcuuuccguccacggcagccaacacagcggaaugauagucaacgacaccggccaugaaaccgacgaaaaccgggccaaaguagaaaucaccccaaacucaccccgcgcagaagccacccucggaggguucggaagccucggacucgacugcgaaccacgcacuggacuagacuucucagaccuguacuaucucacgaugaacaauaaacauuggcuaguacacaaagagugguuccacgauauaccacuaccauggcacgccggagcagacacaggcacaccccacuggaacaacaaagaagcccucguagaguucaaagacgcacacgccaaacgucaaaccgucguaguacucgguucacaagagggcgcuguacacaccgcacuagccggcgcccucgaagccgaaauggauggagccaaagggcgccuauccucaggccaccuaaaaugccgacucaaaauggacaaacuucgccucaaagggguaucauacucccuaugcacagccgccuucaccuucacaaagauacccgccgaaacauuacacggcaccgucacagucgagguccaauacgccggcaccgacggacccugcaaagucccggcacagauggcaguagacaugcaaacccucacacccgucggccgccuaauaacagcaaaccccgucaucaccgaaucaaccgaaaacagcaaaaugaugcuggaacucgacccacccuucggcgacuccuacaucguaaucggcguaggcgaaaagaaaauaacccaucacuggcacagguccgguagcaccaucggaaaagcauucgaagcaaccguccgaggcgccaaacggauggcuguacuaggagacacugccugggacuucggcuccguuggcggcgcccuaaacucgcuaggcaaaggaauccaccaaaucuucggcgccgccuuuaaaagccuauucggaggaaugagcugguucucacaaauccucaucggaacacuacuaauguggcugggacugaacaccaaaaacggaagcauaucacuuaugugccucgcacuagguggcguucuuaucuuccucagcacagcgguaucugcaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9456 - RNA, 2311 nt, Artificial Sequence
  ZIKV prME variant mRNA Design 3 opt
gggagaaagcuuaccaugaagaaacggcgaggcgccgacacaagcgucggcaucguaggccuacuccuaaccaccgcuauggcagccgaaguaacacgccgaggaagcgcauacuauauguaccuagaucgcaacgacgcaggcgaggccaucagcuuccccaccacauuaggcaugaauaaaugcuacauccaaauaauggaucuaggccacaugugcgaugccacaaugaguuacgaaugcccaaugcucgacgagggagucgaacccgacgacguagacugcuggugcaacaccacuucaacaugggucguauacggaaccugccaccacaagaaaggcgaagcaaggagaucaaggagagcugucacgcuccccucacacagcacccgcaaacuacaaacacggucccaaaccuggcuggaaagccgagaguauacaaaacaccuaauccgcgucgaaaauuggauauucagaaaccccggcuucgcgcucgcagcagccgcaauagcauggcuacucggcucaagcacuucacaaaaagucaucuaucuagucaugauccuucucaucgcaccagcauacaguauacgcugcauagggguaagcaaccgggacuucguugaaggaauguccgggggcacguggguagacauaguacuagaacacggaggaugcguaacgguaauggcccaagacaaacccacaguggacaucgagcuaguaacgacaacagucagcaacauggccgagguacggucauacugcuacgaggcaagcauaucagacauggcauccgacucaaggugccccacacagggcgaggccuaccucgacaagcaaagcgacacacaauacgucugcaaacggacccucguagauagaggcuggggcaacggaugcggccucuucggaaaagggagccuaguaacaugcgcaaaauucgccugcagcaagaaaaugaccggaaaaagcauacaaccagaaaaccuugaauaccgcauaaugcuaagcguacacggcagccaacacagcgguaugaucguaaacgacacaggacacgaaaccgacgaaaauagagcaaaaguagaaauaacaccgaacuccccucgggcagaagccacacucgggggauucggaagccuaggccuagacugcgagcccagaaccggacuggacuucagcgaccucuacuaccuaacaaugaacaacaagcacuggcuaguacacaaagaaugguuccacgacauaccucucccauggcacgcaggggcagacacaggcacaccccacuggaacaauaaagaagcccuaguggaguucaaagacgcccacgcaaaaagacaaaccguaguaguccucggaagccaagaaggcgccguccacaccgcgcuagccggggcgcuggaagcggaaauggacggcgccaaaggacgacuaagcagcggccaccuaaaaugccgacuaaaaauggacaaacuaaggcucaaaggcguauccuacucacucugcacagccgccuucaccuucacaaaaauaccagcagagacgcuccacggcacagugacgguggaaguccaauaugccggcacagacggaccaugcaaggugccagcacaaauggcggucgacaugcaaacacuaacacccguaggccgccuaauaaccgccaaccccguaaucaccgaaagcacggaaaauucgaaaaugaugcuagagcucgacccaccguucggagacucauacaucgucauaggagugggcgagaaaaagauaacacaccacuggcaccgaagcggcuccacaaucggaaaagcauucgaagccacaguaagaggggccaagagaauggccguacucggagauacagcaugggauuucgggucaguaggcggagcccuaaacagccuaggcaaaggcauccaccagaucuucggagcagcauucaaaagucucuuuggaggaauguccugguucucccaaauacugaucggcacacuacugauguggcugggacuaaacaccaaaaacgggagcaucucacucaugugucuggcacugggcggaguacucaucuuccuaagcacagccguaucagcaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9457 - RNA, 2308 nt, Artificial Sequence
  ZIKV prME variant mRNA Design 3 opt
gggagaaagcuuaccaugaaaagacgcggcgcggacaccuccgucggcauagucggucuucugcucacaacagcaauggccgcagaggucacacgaagaggcagcgccuacuacauguaccucgaccgaaacgacgcaggcgaagcaaucucauuccccacaacccuaggcaugaacaaaugcuacauccagauaauggaccuaggccacaugugcgacgccacaauguccuacgaaugcccuauguuagacgaaggaguugaaccagacgacguagacugcuggugcaacacaacaucaacgugggugguguauggcacaugccaucacaagaaaggagaagccagacgcagcagacgagcagucacccuacccagccacucaacacgaaaacuccaaacacggucacagacauggcucgaaagccgcgaauacacgaaacaccuaauccgggucgagaauuggaucuuccgcaauccaggauucgcccucgcagccgcagccaucgccuggcuacuaggaagcuccaccucacaaaaagucaucuaccucgucaugauacuccuaauagcaccagccuacuccaucagaugcauaggcgucagcaaccgcgacuucguagaaggaaugaguggcggcaccugggucgacaucguccuagaacacggcggaugcguaaccgugauggcgcaggacaaacccaccguggacauagagcuagucaccaccaccgucucgaacauggcagaaguacgauccuacugcuacgaagccagcauaagcgacauggcaagcgacagucgcugccccacccaaggagaagccuaccuagauaaacaaagcgacacccaauacgucuguaaacgaacccuagucgaccgcggauggggcaacggcuguggacucuucgggaaaggcucacuggugacaugcgccaaauucgcgugcucuaagaaaaugacagggaaaucuauccaacccgaaaaccuagaauaccgcaucaugcuaagcguacacggcucacaacacuccggcaugauaguaaacgacacaggacacgaaaccgacgagaacagagccaaaguagaaaucacgcccaacucccccagggccgaagcaacccucggcggcuucggaucccuugggcuagacugcgaacccagaaccggacucgacuucagcgaccucuacuaccuaacaaugaacaacaaacacugguuagugcacaaggaaugguuccacgacaucccacuaccauggcacgcgggagcagacacuggcacaccccacuggaacaacaaagaagcucucgucgaguucaaggacgcccacgccaaaaggcaaacagucgucguccuagggagccaggaaggagccgugcacaccgcacucgcuggcgcccuggaagccgaaauggacggagccaaaggcagacuaucaagcggacacuuaaaaugcagacuaaaaauggauaaacuccgucuaaaaggcguaagcuacagccuaugcaccgccgcguucacauucaccaaaauaccagcagaaacucuccacggcaccgugacaguagaaguccaguacgccggcacggauggaccauguaaaguaccggcccaaauggcaguagacaugcaaacacucacacccguaggacgccuaaucaccgcaaaccccgugauaaccgaaucaaccgaaaacagcaaaaugaugcucgaacucgacccaccauuuggagauagcuacaucgugaucgggguaggagagaaaaagaucacgcaccauuggcaccgcucaggcucaaccauaggaaaggccuucgaagcaaccguacgaggagcaaaacgcauggcaguacuaggagacacugccugggacuucggcucaguaggcggagcacucaacucccuaggcaaaggaauacaccaaaucuucggcgccgccuucaaaagccucuucggcgguauguccugguucagccaaauccugaucggcacacuucuaaugugguuaggacucaacaccaaaaacggcuccaucucccuaaugugccuagcacucggcggcguacucaucuuccuaagcacagcaguguccgcaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9458 - RNA, 2305 nt, Artificial Sequence
  ZIKV prME variant mRNA Design 3 opt
gggagaaagcuuaccaugagacgaggcgccgacacaucaguuggaauaguaggacuacuacuaaccacagccauggccgcagaaguaacaagacgcggauccgccuauuacauguaccuagaccgaaaugacgcaggcgaggcgaucagcuucccaacaacgcugggaaugaacaaaugcuacauacaaauaauggaccuuggccacaugugugacgcaacaaugagcuacgaaugccccaugcucgacgagggcgucgaaccagacgacguagacugcuggugcaauacaacaagcaccuggguagucuacggaacaugccaccacaaaaagggagaagcacgacgcagccgccgagcgguaacccuccccagccauucgacccggaaacuacagacccgaagccaaaccuggcuagaaucacgcgaauacaccaaacacuuaaucagaguggagaacuggaucuuccgcaaccccggauucgcacuagcagcagccgcaauagcauggcuccuaggcagcagcacaagccaaaaggucauauaccucgugaugaucuuacucauagccccagccuacagcauacgaugcauaggcguguccaacagagacuucgucgaaggcaugagcggaggcacauggguagacauaguacucgaacacggcggaugcguaacggugauggcccaagacaaaccaacaguagauaucgaacuggucaccaccacagucagcaauauggcagaaguaagauccuacugcuacgaagcauccauaagcgacauggcaagcgauagcagaugccccacacagggcgaagccuaccucgacaaacaaucagauacacaauacgucugcaagcgcacccuggucgacagaggcuggggaaauggaugcggccuauuuggaaaagggucccuggucacgugcgcaaaguucgcgugcagcaagaaaaugaccggcaaaagcauccaacccgagaaccucgaauacagaauaaugcucagcgugcacgggagccaacacagcggcaugauaguaaacgacacuggacacgaaaccgaugagaaccgagccaaagucgaaauaaccccuaacucaccacgagcagaagcgacacuagggggcuucggcagucucgggcuagacugcgagcccagaaccggccucgacuuuuccgaccucuacuaccuaaccaugaacaacaaacacuggcucgugcacaaagaaugguuccacgacaucccacucccauggcacgcaggagcagacacaggaacaccccacuggaacaacaaagaggcacucgucgaguucaaggacgcccacgcaaaaagacaaacaguaguaguucucggaagccaagaaggagcaguacacaccgcccuugcaggggcccucgaagccgagauggacggagcgaaaggccggcuaucgucaggccaccucaaauguagacuaaagauggacaaacucagacuaaaaggagugucauacagccugugcacagccgcguucacauucacaaaaauaccggcggaaacacuccacgggacggucaccguagaggugcaauacgccggcaccgacggccccugcaaagucccggcacagauggccgucgacaugcaaacccucacaccaguaggccgacuaaucacagccaacccgguaauaacggaauccacagaaaacucaaaaaugaugcuagaacucgacccaccauuuggcgacagcuacauagugauagggguaggcgaaaagaaaaucacacaccacuggcaccgaagcggcagcaccauagggaaagcauucgaagcaaccguacggggagcaaaacgcauggcaguacucggggacacagccugggacuucggcagcguaggcggugcacuaaacucacuaggcaagggcauacaccaaauauucggggcggccuucaaaucucuauucgggggcaugagcugguucucacaaauccuaaucgggacccuccucauguggcuaggacucaauacaaagaacggcagcauaucgcucaugugccuggcauuaggaggaguccuaaucuuccucagcacagcaguaagcgcaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9459 - RNA, 2302 nt, Artificial Sequence
  ZIKV prME variant mRNA Design 3 opt
gggagaaagcuuaccaugcgcggagcagacaccagcgucggcaucgugggccuccuucugacaacagccauggccgcggagguaacacgaagaggcagcgcguacuacauguaccuagacagaaaugacgcaggagaagccaucucguucccaacaacccuaggaaugaacaaaugcuacauccaaaucauggaccuaggccacaugugcgacgccaccaugagcuacgaaugcccaaugcucgacgaaggaguagagcccgacgacguagacugcuggugcaacaccaccagcacauggguaguauacggaaccugccaccacaaaaagggggaagcucgccgaagccgccgcgcugucacacuccccagccacagcaccagaaaacuccaaacccgcucacaaaccuggcuagaaagccgagaauacaccaaacacuuaauccgaguggaaaacuggauauucaggaaucccggcuucgcccuugccgccgccgcaauagccuggcuccucggcagcucaaccucacaaaaagucauauaccuagucaugauacuccuaauagcccccgccuacuccauaagaugcauaggcguaagcaacagagacuucguagaagggaugucuggcggcaccuggguagacauuguacucgaacacggcggcugugugacagugauggcccaagacaaaccaaccguagacaucgagcuagucacaaccaccgucuccaacauggccgaagucagauccuacugcuacgaagcgagcauauccgacauggcguccgacagccgaugccccacacagggcgaagccuaccucgacaaacaaagcgacacccaguacguauguaaacgcaccuuaguggacagaggauggggcaacggcugcggacucuucggcaagggaucccucgucacaugcgccaaauucgcaugcucgaagaaaaugaccggcaaaagcauccaaccagaaaaccucgaauaccgaauaaugcucucgguacacggcagccaacacagcggaaugaucguuaacgacaccgggcacgagacagacgaaaaccgugccaaagucgaaauaacccccaacagcccaagagcagaggccacccucggcggauucgguagccuaggacuagacugcgagcccagaaccggccuggacuucucagaccucuacuaccuaacuaugaacaacaaacacuggcuaguccacaaagaaugguuccacgacauaccccuacccuggcacgccggagcagacacaggcaccccacacuggaacaacaaagaagcccuaguagaguucaaggacgcacacgcaaaacgccaaacaguuguaguccuuggcagccaagaaggagccguccacaccgcccucgcaggagcccuagaagcagaaauggauggcgcgaaaggccgccuaucauccggccaccuaaaaugcagacucaagauggacaaacuaagacucaagggagucuccuacucccuauguaccgcagccuucacguucaccaaaaucccagcagaaacacuccacggcaccguaaccgucgaaguacaauaugccgguacagacggacccugcaagguaccagcccaaauggccguggacaugcaaacccuaacacccguaggccgccugaucacagcgaaccccguuaucaccgaauccacagaaaacucaaagaugaugcucgaacuagacccacccuucggagacuccuacauagucaucggcgucggggaaaagaaaauaacacaccacuggcaccgcuccggcagcaccauagguaaagcauucgaggccaccguacgaggagccaaacgaauggccguacuaggcgacaccgccugggacuuuggauccgugggcggcgcacuaaacucacuaggcaaaggaauacaccaaaucuucggggcagccuucaaaagccuauucggcggaaugucuugguucucacaaauccucauaggaacacuccugauguggcucggacugaacaccaaaaacggauccauaagucuaaugugccuagcacugggcggaguccuaaucuuccugagcaccgcaguauccgcgugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9460 - RNA, 2299 nt, Artificial Sequence
  ZIKV prME variant mRNA Design 3 opt
gggagaaagcuuaccaugggcgccgacacaucggucggaauagucggacuacuccucacaacagccauggcagcggaagucacgcgaagaggcuccgccuacuacauguaccucgaccgcaacgacgcaggggaagcgaucagcuuccccaccacccucgggaugaacaaaugcuacauacaaauaauggaucuaggacacaugugcgacgcgacgaugagcuacgaaugccccaugcuagacgaaggaguagaaccagacgacgucgacuguuggugcaacacaacauccacuugggugguauauggaaccugccaucacaagaaaggagaagccaggaggucccgcagagccgucacacuccccagccacuccacucgcaagcuacaaacaagaucacaaaccuggcuagaaagcagggaauauacaaaacaccuaauaagaguggaaaacuggaucuucagaaaccccggcuucgcccuagccgcagcggccauagccuggcuacucggcagcuccacaagccagaaagucaucuaccucguaaugauccuucugaucgccccagcguacuccauacgguguauaggaguauccaaccgcgacuucgucgaaggcaugucaggcggaacaugggucgacauaguccucgaacacgguggaugcgucacgguaauggcacaggacaaacccacggucgauaucgagcuaguaacaaccacggucuccaacauggccgaaguccgcucauacugcuacgaagccuccauauccgacauggcguccgacucccgcugcccaacccaaggcgaagccuaccucgacaaacaauccgacacccaauacguaugcaaacgaaccuuagucgaccgcggaugggggaacggauguggccuauucggcaagggcucgcucguuacaugcgccaaauuugccugcucgaagaaaaugacgggaaaaagcauccaacccgaaaaccuagaauacagaauaaugcuaucgguccauggaucacaacacucagggaugauaguaaacgacacgggacacgagaccgacgaaaaccgcgcgaaagucgaaauuaccccaaacaguccucgcgcagaagcaacccuaggcggguucggaagccucggccucgacugcgaaccacggacaggcuuagacuuuagcgaccuguacuaccucaccaugaacaacaaacacugguuaguccacaaagaaugguuccacgacauaccccuaccauggcacgccggagccgauacagguacaccccacuggaacaacaaggaagcgcuaguggaguucaaagacgcccacgcaaaacgccaaaccgucgucgucuuaggcagccaagaaggagccguccacaccgcgcucgccggagcccuagaagcagagauggacggagcaaaaggacgccuaaguucagggcaccuaaagugccgacugaaaauggacaagcugcgucucaaaggcguguccuacucacuaugcacggcggcauuuacguucaccaaaauccccgcagaaacccuacacggaaccgucaccguagaaguccaauaugccggaacggacggacccugcaaggucccagcccaaauggccgucgacaugcagacccugacccccguaggccggcuaauaaccgcaaacccgguaauaacagaaucaacagagaacucaaaaaugaugcucgaacuggacccacccuucggcgacuccuacauagucaucggaguaggagaaaagaaaauaacccaccacuggcaccgcagcggaagcaccauaggcaaagcguucgaggcgaccguccgcggcgccaaaaggauggcaguccuaggagacaccgcaugggacuucggaagcguaggaggcgcccucaacucacuaggaaaaggaauccaccaaaucuucggagcggcguucaaaagccucuucggcggaaugagcugguucucacaaauccucaucggaacccugcuaauguggcucggacuaaacaccaaaaacgggagcaucucccuaaugugucucgcacuagguggcguccucaucuuccucagcacagcaguaucagcgugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9461 - RNA, 2296 nt, Artificial Sequence
  ZIKV prME variant mRNA Design 3 opt
gggagaaagcuuaccauggccgacacaagcguaggaauaguaggacugcuccugaccacagcaauggcagcagaaguaacaagacgaggcuccgcguauuacauguacuuagaccgaaacgacgccggagaagccauaucuuuccccaccacccuagggaugaacaagugcuacauucaaauaauggacuugggccacaugugcgaugcgaccaugagcuacgagugccccaugcuagacgagggcgucgaaccagacgacguagacugcuggugcaacacgaccucaacauggguaguauacgggacaugccaccacaagaaaggagaggcacgaagaagccgacgagccguaacgcuacccucccacucgacacgcaaacuccaaacaagaucccaaacauggcuggaaagcagggaauacacaaaacaccucauuagaguagaaaacuggauauuucgaaacccaggcuucgcccuagcagcagcagcgaucgccuggcuccucggaagcagcaccucgcaaaaaguaauuuaccucguaaugauacuacuaaucgcgccagcauacagcaucagguguaucggaguaagcaacagagacuucguagaaggcaugucaggaggaaccuggguagacaucguacuagaacacggaggaugcguaaccgugauggcucaagacaaaccaaccguagacaucgagcuaguaaccacuacagucuccaauauggcugaagucagauccuacugcuacgaagccucaauuagcgacauggcgagcgacagccgaugcccgacccaaggagaagccuaccucgacaaacaaucggacacccaauacguaugcaaaaggacacuggucgaccgaggcugggggaacggcugcggccuguucgggaaaggcagccucguaacaugcgcgaaauucgccugcuccaagaaaaugacuggaaaaucaauccaaccagaaaaccuggaauacagaaucaugcucuccguacacgggagccaacacagcggaaugaucguaaacgacaccggccacgaaaccgacgaaaaccgcgcgaaagucgaaauaacgcccaacucacccagagccgaggccacacuaggagguuucggaucacuagggcucgacugcgaacccaggaccggacuagacuucagcgaccucuacuaccucacaaugaacaacaaacacuggcuagugcacaaagaaugguuucacgacauaccccuacccuggcacgcaggcgcagacaccggcacgccccacuggaacaacaaagaagcacucgucgaguucaaagacgcccacgccaaacgccagaccguagucguccuaggaagccaagaaggagcaguccacaccgcccuagcaggggcucuagaagccgaaauggacggcgcaaagggacgacucagcagcggccaccuaaaaugccgccugaaaauggacaaacucagacucaaaggaguaucauacucacuaugcacagcagcauucacauucaccaaaauccccgcagaaacccuccauggaacagucacagucgaaguucaauaugccggcacagacggaccaugcaaaguacccgcacaaauggccguagacaugcagacgcuaacccccgucggaaggcucauaacagcuaaccccgucauaaccgaaagcacagaaaacuccaaaaugaugcucgaacucgaucccccguucggcgacucguacauugucauaggcgucggagaaaagaaaaucacacaccacuggcaccgcucaggcagcacaaucggcaaagccuucgaagcgacaguacggggagccaaacgaauggccguccucggagacacagccugggacuucggaagcgucggaggagcccuuaacagucugggaaaaggaauccaccaaaucuucggggcagcuuucaaaagccucuucggcggcaugagcugguucagccaaauccuaaucggaaccuuacuaauguggcucgggcugaacacgaaaaacggguccauaagccucaugugccucgcccugggcggaguccucauauuccuaagcacagccgucuccgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9462 - RNA, 2293 nt, Artificial Sequence
  ZIKV prME variant mRNA Design 3 opt
gggagaaagcuuaccauggacacaagcgucggaauagugggucuccuacucacgaccgcaauggccgcagagguaacccgaaggggcucugcauacuacauguaccuggaccgcaacgacgcaggcgaagccauaucauuccccacgacacucggaaugaacaaaugcuauauacagaucauggaccucggacauaugugcgacgccaccauguccuacgaaugccccaugcuagacgaaggcguggaaccagacgacgucgacugcugguguaacaccacgagcaccuggguagucuacggcacaugccaccacaagaaaggggaagccagaagaucacgccgagcgguaacgcucccgucacacuccacaagaaaacuacagacacgaagccaaaccuggcucgaaagccgcgaauacaccaagcaccuaauaagaguagagaacuggauuuuccgaaacccuggguucgcgcuagcagcugcagcaauagccuggcuccuagggagcucaacgucacagaaagucaucuaccucgucaugauacuacugaucgcacccgccuacuccauccgaugcauaggcgucucaaaccgcgacuucguagaaggcauguccggagggaccugggucgauaucguucucgaacacggaggaugcguaacagucauggcccaggauaaacccacaguagacauagaacucguaacaacgacagucucaaacauggccgaaguaagguccuacugcuacgaagcaucaaucucggacauggccuccgacucacgaugccccacccaaggcgaagccuaccucgacaaacaaucagacacccaauaugucuguaaacggacccucguagaccgcggcuggggcaacggaugcggccuauucggcaaaggcucccuagugaccugcgccaaauucgcaugcucaaagaaaaugacaggcaaaagcauacaacccgaaaacuuagaauaccguaucaugcuuuccguacacggcagccaacacuccggcaugaucgucaaugacaccggccacgaaacugacgaaaauagagcaaaaguagaaaucacaccaaacagcccacgagcggaagcgacgcucggcggcuuuggcucacucggccucgacugugagccaagaacaggacuagacuucuccgaucuauacuaccucacgaugaacaacaaacauuggcuaguacacaaagaaugguuucaugauaucccccuaccuuggcacgccggagccgacacaggaacaccucacuggaacaauaaagaggcacucguagaguucaaagacgcacacgccaaaagacaaaccguagucguccuuggcucacaagaaggcgccguacacaccgcccucgccggagcacucgaagccgagauggacggcgccaaaggccgacuaucuagcggccaccucaagugcaggcucaagauggauaaacuacgacucaagggaguaucauacucccuaugcaccgcagcauucacguucacaaaaauacccgcagaaacccuacacggcacagucacaguggagguacaguacgccggcacagacggaccauguaaagucccagcacagauggccguugacaugcagacccuaacccccgucgggagacucaucacagcaaacccaguaaucacagaaagcacagaaaacucaaagaugaugcucgaacuugacccacccuucggcgacuccuacaucgucauaggaguaggagagaagaaaauaacccaccacuggcaccgcuccggaaguacaauaggcaaagcauucgaagccaccguccgaggcgcaaaacgcauggcgguccuaggcgacaccgcgugggacuucggaagcgucggcggcgcacucaacucucugggaaaaggcauacaccagauuuucggcgcagccuucaaaucccuauucggcggcaugagcugguucagccaaauacucaucggcacucuccuaauguggcuaggccucaacacgaaaaacggcagcauaagccuaaugugccucgcccuaggaggaguccuaauauuccuaucaacagcagugagcgcuugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9463 - RNA, 2290 nt, Artificial Sequence
  ZIKV (strain ZikaSPH2015) Polyprotein(108-794) mRNA Design 3 opt
gggagaaagcuuaccaugaccagcgucgggaucgucggccuccuacuaaccacagcaauggcagcagaaguaaccaggcgcgguuccgccuacuauauguaccucgacagaaacgacgcgggcgaagccaucuccuuuccaaccacacucggcaugaacaaaugcuacauccaaauaauggaccucggacacaugugcgacgccacgauguccuacgaaugucccaugcuagacgaaggugucgaaccagacgacguagacugcuggugcaacaccaccagcaccugggugguauacggcacaugccaccacaagaaaggcgaagccagacgaucgcgccgagccgucacgcuccccucccacucgaccagaaaacuacaaacccgcucucagaccuggcucgaaucgcgagaauauaccaaacaccuuauacgagucgaaaacuggauauuccgcaacccaggauuugcauuagccgccgcagcaaucgccuggcuacucgggagcucaacaucacaaaaaguaauuuaccucgucaugauccugcucauugccccagcuuacucaauacgauguaucgggguaagcaaccgagacuuugucgaaggcaugagcggagggaccugggucgacaucguccucgaacacggcggcugcguaacagucauggcccaggauaaacccaccgucgacauugagcuagucacaaccacagucucgaacauggccgaaguacgcagcuacugcuacgaagcguccauaagugacauggccagcgacucccgcugccccacucaaggcgaagccuaccucgauaaacaaagcgacacccaauacguaugcaaaagaacccucgucgaccgaggcuggggcaacgguugcggccuauucggaaaaggcucccuaguuaccugcgcaaaguucgcaugcucaaagaaaaugaccggcaaauccauccaaccagaaaaccuggaauaccgcauaaugcugagcguccacggcucccaacacuccggaaugaucgucaacgacacagggcacgaaacggacgaaaaccgcgcaaaaguugaaauaacccccaauagcccccgcgcagaagcaacacucggcggcuucggaagccuagggcucgacugcgaaccccgcacaggccucgacuucuccgaccuguacuaccuaaccaugaacaacaaacacuggcucguccacaaagaaugguuccacgacaucccacuaccauggcacgcgggugcagacacaggcacaccccacuggaauaacaaagaagcccucguagaguucaaagaugcccacgcaaaaagacagaccgucguaguccucggcagucaagaaggcgccguccacacggcucucgccggagcccuagaagccgaaauggacggagcaaaaggaaggcuauccucaggccaccucaaaugcaggcucaagauggacaaacuaagacucaaaggcguaagcuacagccucugcacagccgcauucaccuucacgaaaauucccgcggaaacgcuacacggcacagugacagucgaaguccaguacgcaggcacagacgggccaugcaaaguacccgcacaaauggcggucgacaugcagacacucacccccguaggaagacuuaucacagcaaaccccguaaucacagaauccacagaaaacagcaaaaugaugcuagaacuagauccacccuucggagacuccuacaucguaauaggcgucggagaaaagaaaaucacucaccauuggcacagaagcggcuccacaauagggaaagccuucgaggcgacaguacgcggagcuaaacgcauggccguacucggggacaccgccugggacuucggcuccgucggcggcgcacuaaacagucucggcaaaggaauacaccaaaucuucggcgccgccuucaaaucccuauucggaggcaugagcugguucagccaaauccugauaggcacauugcucaugugguuaggccucaacaccaaaaacggcagcaucagccucaugugccucgcacucgggggaguacuaauauuccuauccaccgccgucuccgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9464 - RNA, 2290 nt, Artificial Sequence
  ZIKV prME variant mRNA Design 3 opt
gggagaaagcuuaccaugaccuccguaggcaucgugggacuccuccucacaaccgcaauggccgcagccguaaccagacgcggcuccgcauauuacauguaccucgacagaaacgacgccggcgaagcgaucucguuucccaccacccucgggaugaacaaauguuacauccaaaucauggaccucggccacaugugcgacgccaccaugagcuacgaaugccccaugcuagaugaaggaguagaaccagacgacguagacugcuggugcaacaccacaucaacauggguaguguacggcacaugucaccacaagaaaggugaagcacggcgcagcagacgcgcgguaacgcuccccucacacuccacacgcaaacuccaaaccagaagccaaaccuggcuagaaagccgagaauacaccaaacaccucauacgagucgaaaacuggauauucagaaaccccggauucgcccucgcggccgcggcaauagcuuggcuacucggauccucgaccucacaaaaagucaucuaccuggucaugaucuuacucauagcaccagcauacucgauccgguguaucggcgugucuaaccgcgacuuugucgagggcauguccggcggcaccuggguggacaucguccuagaacacgggggcugcgucaccguuauggcccaagacaaacccacgguagacauagagcucgucaccaccacaguauccaacauggccgaaguccgaucauacugcuacgaagccuccauaagcgacauggccucagacucccgcugccccacacaaggugaagcauaccuagacaaacaaucagacacgcaauacgugugcaaacgcacucuggucgaccgaggcuggggcaacggcugcggccucuucggcaagggaagccuaguaaccugcgccaaauucgccugcucaaagaaaaugaccggcaaaucaauccaacccgaaaaccucgaauaccgaaucaugcuaucaguccacggaucacagcacucuggcaugauagucaacgacacaggucacgaaacagacgaaaaccgcgccaaaguugaaaucacccccaacucaccucgagcagaagccacccucggaggauucggcucccuaggccuagacugcgaaccacgcacaggacuagacuucagcgaccucuauuaccucaccaugaacaacaaacauuggcuaguucacaaagaaugguuccacgacauaccccucccauggcaugccggugcagacaccggaacaccucacuggaacaacaaggaagcccucguagaguucaaggacgcacacgcaaaacgacaaacagucguaguccucggaagccaggaaggagccguucacaccgcacuugcaggagcccuggaagccgaaauggacggugccaaaggccgccuuuccucagggcaccucaaaugccgccucaaaauggacaaacuacgccucaaaggcgucucuuacucccucuguacugccgccuuuaccuucaccaagauaccagcagaaacucugcacggcaccgucacagucgaaguacaauacgcuggcaccgacggacccugcaaaguccccgcccaaauggccgucgacaugcagacccuaacccccguaggaagacuaaucacagccaauccagucaucaccgaauccacagaaaacucaaaaaugaugcucgaacucgauccacccuucggagacagcuacauugucaucggcgucggugaaaagaaaauaacacaccacuggcaucgaucaggcucaacgaucggaaaagcguucgaagcuacaguacgaggcgccaaacggauggccguccucggcgacaccgcuugggacuucggcuccgucggaggugcacucaacucacucggcaaagguauccaccaaaucuucggcgcagcguucaagagccucuucggcggcaugucaugguuuucacaaauacucauaggaacacuacucauguggcucgggcucaacacaaagaacggcagcauaagccucaugugccucgcacuuggcggcguccuaaucuuccuaucgacagcaguguccgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9465 - RNA, 2302 nt, Artificial Sequence
  ZIKV prME variant mRNA Design 3 opt
gggagaaagcuuaccaugcgcggcgcggacacaucagucggcaucgucgggcuacuacucacgacggccauggcagccgcugucacaagacgaggaagugccuauuacauguaccucgaccgcaacgacgccggggaagccaucuccuuccccacaacacucggcaugaacaaaugcuacauccaaaucauggaccucggccauaugugcgacgccaccaugucauacgagugcccaaugcuagacgaaggagucgagccagacgacgucgacugcugguguaacacaaccuccacauggguaguuuauggcacgugucaccacaaaaagggcgaagcccgccgaagccgcagagccgucacccuaccuucacacagcacccgcaagcuacaaacacgcagccaaaccuggcuggaaucacgagaauacacaaagcaccuaauacgcgucgagaacuggauauuccgcaaccccggcuucgcacuagcggccgcagcgaucgcauggcuccucggcuccagcacaucgcaaaaggucaucuaccucguaaugauacuccuaaucgcacccgcguauagcauacgguguauaggcgucagcaaccgagacuucguagaaggcaugagcggugguacaugggucgacaucguccucgaacacggaggcugcgucacagucauggcacaagacaagccaacaguagacaucgaacuuguaaccaccaccguuagcaacauggcugaaguuagaucauacugcuacgaagccagcauaagcgacauggccucagacagccgaugcccaacgcaaggagaagccuaccuagacaaacaaucggacacccaauacgucugcaaacgaacccuagucgaccgcggcuggggaaauggaugcggccuauucggaaaaggaucccucgucacaugcgccaaauucgcgugcucaaagaaaaugaccggcaaaagcauacaaccagaaaaccuagaauacagaauaaugcucucaguccacggcagccaacacagcggcaugaucgucaacgacacaggccacgaaaccgacgaaaacagagcaaaagucgagauuacaccuaacaguccacgcgcugaagccacccuaggcggauucggaucgcuaggccucgacugcgaaccacguaccggacuagacuucuccgaccuauacuaccucacaaugaacaacaaacacuggcucguacacaaagaaugguuccacgacauaccccuacccuggcacgccggagcagacaccgggacaccacacuggaacaacaaagaagcccucgucgaguucaaagacgcccacgcaaaacgccaaacagucgucguauugggcucccaagaaggggcaguccacacagcccucgcgggagcccuagaagcagaaauggacggcgccaaaggacgacuaagcuccggccaccuuaagugcagacucaaaauggacaaacugcgacuuaaaggagucucauacucacucugcacagcagcuuucacauucacaaaaauaccagcagaaacccuucacggcacagugacgguagaaguccaguacgccggaaccgacggccccugcaaaguacccgcccaaauggccguagacaugcaaacgcuaaccccaguuggacgucucauaacagcuaacccaguaaucaccgaaucgacugaaaacucgaagaugaugcuagaacucgacccaccauucggcgacagcuacaucguaaucggcgucggcgagaaaaagauaacucaucacuggcaccgcagcgguagcacaaucggcaaagccuucgaagccacgguaaggggagcaaaacgcauggcaguccugggggacaccgcaugggauuucggaucggugggcggggcccuaaacucacugggcaaaggaauccaccagaucuucggcgccgcuuucaaaucacucuucggcggcauguccugguucucacaaauacucaucggaacacuacucauguggcucggacucaacaccaaaaacggaagcauaagccucaugugccucgcacuaggaggaguccucauuuuccucucaaccgccguuuccgcaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9466 - RNA, 2326 nt, Artificial Sequence
  ZIKV prME variant mRNA Design 3 opt
gggagaaagcuuaccaugcgcggccugagcagcagaaaacgacgaucacacgacguacucacaguccaauuccucauacucggaaugcuacucaugaccggcggggucacgagaagaggcagcgcauacuacauguauuuagaccgaaacgacgccggcgaagccaucuccuuccccaccacacugggcaugaacaaaugcuacauccaaaucauggaccuaggacacaugugcgacgcgaccaugucauacgaaugcccgaugcucgacgaaggcgucgaaccagacgacgucgauugcuggugcaacaccacauccaccuggguaguauacggcacaugccaccacaagaaaggagaagcccgacgcagccggcgcgcugucacccucccgucacacucuacccgaaagcugcaaacccgaucacagaccuggcuggaaucacgcgaauacacaaaacaccucauccgcgucgaaaacuggauauuccgcaaccccggcuucgcccuagcagcugcagccaucgccuggcuacucggcuccagcaccagccaaaaggucaucuaccucguaaugauccuccucauagccccagcauacucaauccgaugcaucggagugagcaaccgugacuucgucgaaggaauguccggcgggacaugggucgauauugugcucgaacacggaggcugcgucacaguaauggcccaagacaaaccaaccguagacauagagcucguuaccaccaccguauccaacauggccgaagugcgcuccuacugcuacgaagcaagcaucagcgacauggccuccgauucaagaugccccacgcaaggcgaagcauaccuagacaaacaaucagacacacaauacgucugcaaacgaacccucgucgacaggggaugggggaacggcugcggccuuuuugggaaaggaucccuagucaccugugccaaauuugcaugcagcaaaaagaugaccggaaaaucaauucaaccagaaaaccucgaauaccgaauaaugcucucaguccacggcagccagcacagcggaaugaucguaaacgauacaggccacgaaacagacgaaaaccgcgccaaaguagaaauaacacccaacucaccccgcgcagaagccacacuagguggauucgggagccuaggacuagacugcgaaccccgcacaggucuagacuucuccgaccucuacuaccucacaaugaacaacaagcacuggcuaguccacaaagaaugguuccacgacaucccgcuaccauggcacgccggcgccgacaccggaacaccccacuggaacaacaaagaagcccuagucgaguucaaagacgcacacgcaaagagacaaacugucguaguccucggcucccaagaaggcgccguccauaccgcacucgcaggcgcauuagaagccgagauggacggcgcaaaaggacgacuaagcagcggacaccucaaaugccgccuaaaaauggacaaacugagacucaaaggagucucuuacucacucugcaccgccgcauucaccuucacgaaaauccccgccgaaacccuccacgguaccguuaccgucgaaguccaauaugcagggacagacggcccaugcaaaguccccgcccaaauggcagucgacaugcagacccucacgccagucggcagacuaaucacagcaaaccccgucauaaccgaaagcacggaaaacuccaaaaugaugcucgaacuagaucccccauucggcgacucauacaucgucaucggaguaggugagaaaaagaucacccaccacuggcacagaagcggaagcacgaucgguaaagccuucgaagccacuguccgaggugccaaacgcauggcugugcucggagacaccgccugggacuucgggagcgugggcggagcccuaaacagccuagggaaaggcauacaccagaucuucggcgcagcauucaagagcuuauucggcgggaugagcugguucucacaaauccucaucggaacacuccucauguggcuaggacucaacaccaaaaacggaagcauaagucugaugugccucgcccucggaggaguccuuauauuccuauccacagccgucagcgcgugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9467 - RNA, 2326 nt, Artificial Sequence
  ZIKV prME variant mRNA Design 3 opt
gggagaaagcuuaccaugagaggccuaucaagccgcaaaagacggucacacgacguauuaacaguacaauucuuaauccuaggcaugcugcuaaugacaggggcaguuacccgccgaggcucagcguacuacauguaccuggaccguaacgacgccggcgaagcaauuagcuucccaaccacacucgggaugaacaaaugcuacauccaaauaauggaccuaggacacaugugcgacgccacaaugucguacgaauguccaaugcuagacgaaggcgucgagccagacgacgucgacugcuggugcaauacaaccagcacaugggucguauacggaaccugccaccacaagaaaggcgaagcccgccgaucccgccgcgcaguaacccuccccagccacagcacccgaaaacuccaaacccggagccaaacauggcuagagagcagggaguacacaaaacaccugaucaggguagagaacuggauauuccgaaaccccggauucgcacucgccgccgcagcuaucgccuggcuacucggauccuccaccucucaaaaggugaucuaucuuguaaugauccuccucauagcacccgccuacucaauacgcugcauaggaguuagcaacagagacuucgucgaaggcaugagcggcggaacaugggucgacaucguccucgagcacggcggaugcgucacagucauggcccaggacaaaccaaccguagacauagagcuaguaacaacaacaguauccaauauggccgaaguccgcuccuacugcuacgaggcaucaaucucagauauggccucagacucgcgauguccaacccaaggggaagccuaccucgacaagcagagcgacacacaguacguauguaaaagaacccuuguugaccgaggcuggggaaacggaugcggccuauuugguaaaggaucacucguaaccugugccaaauucgcaugcuccaagaaaaugaccggcaaaagcauacaacccgagaaccucgaauaccgcauaaugcucagcguacacggcagccaacacagcgggaugauaguaaacgacaccggacacgaaaccgacgaaaaucgagcgaaaguagaaauaacaccaaacagcccaagagccgaagccacccucggcggauucggaagccucggacuagacugcgagccgcgcacagggcucgacuucuccgaccucuacuaccucacaaugaacaacaaacacuggcucguccacaaagaaugguuccacgacauaccacuccccuggcacgccggcgccgauaccggcaccccacacuggaacaacaaagaggcccuggucgaguucaaagacgcgcacgccaagcgccaaacaguggucguacucggaucacaagaaggcgcaguacacacagcccucgccggagcccucgaagccgaaauggacggcgccaaaggacgccuaagcuccggccaccucaagugccgccucaaaauggacaaauugcgacucaagggagucagcuacucacugugcacagccgccuucacauucacaaaaauccccgccgaaacacugcacggaacagucacaguagaaguacaauacgcaggcacugacggaccauguaaaguaccggcgcaaauggcagucgacaugcaaacccucacgccagucggacgacuaaucaccgccaauccagucaucacagaaagcacagaaaacucaaaaaugaugcuagaacuagaucccccauucggagacagcuacaucgugauaggcgucggcgaaaagaaaaucacccaccacuggcaccgaagcggcucaaccauaggcaaagcguucgaagccaccgucagaggcgcuaaacggauggcaguacucggcgacacggcaugggacuucgguucagucgggggcgcgcuaaacagccucggcaaaggaauccaccaaauuuucggggccgcauucaaaagccucuucggcggaaugaguugguucucccaaauacuaaucggcacccuccugauguggcuaggccuaaacaccaaaaacgguucgaucagccucaugugccuagcguugggaggcgugcuaauauuccuaagcacagccguaagugccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9468 - RNA, 2365 nt, Artificial Sequence
  KU321639.1 prME-long mRNA Design 3 opt
gggagaaagcuuaccaugcgaauaauaaacgcaagaaaggaaaagaaacggcgcggcgcagacacauccgucggaauagugggacuccuacucacaaccgcaauggccgcggaaguaacaagaagaggcucagcguacuacauguaccuagaccgcaacgacgcaggagaagcaauauccuuccccacaacccucggcaugaacaaaugcuacauacagaucauggaccucggacacaugugcgacgcaaccaugagcuacgaaugcccaaugcuagaugaaggcgucgaacccgacgacgucgacugcuggugcaacaccaccuccacguggguagucuauggaaccugccaccacaagaaaggcgaagcccgaagaucaaggagagcagucacacuaccaagccacagcacacgaaaacuacaaacacguucacaaaccuggcucgaauccagagaauacacaaaacaccucauacgagucgaaaacuggauauucagaaaccccggcuucgcccucgcggcagccgcgauagcauggcugcugggaagcaguaccucacaaaaagucauauaccuaguaaugauccuccucaucgcgcccgccuacagcauucgcugcauagguguaagcaaccgggacuucguagaagggaugagcggcgguacaugggucgacaucguacuagaacacgggggcugcguuacaguaauggcacaagauaagcccaccguagacauagaacucgucacaacaaccguaucaaacauggcugaggucagaagcuacugcuacgaagcauccaucuccgacauggcaagugacagucgcugccccacccaaggagaagcguaccucgacaaacaauccgacacccaauacgucugcaaacgaacacucguagaccgcggauggggaaauggcuguggacuuuucggaaaaggcagccuaguaacaugcgccaaguucgccugcagcaagaaaaugacaggcaaaucaauccaaccagaaaaucucgaguaccgcauuauguuaucaguacacggcagccaacacagcggcaugaucgucaacgauaccgggcacgaaaccgacgaaaacagagccaaaguagaaaucacaccaaacagcccaagagcagaagccacacuugggggcuuuggcagccuaggccucgacugcgaaccacgaacaggccucgacuucucagaucuauacuaccucaccaugaacaacaaacacuggcucguacacaaagaaugguuccacgacaucccccuccccuggcaugccggggcagacacgggaacaccccauuggaacaauaaagaagcccuaguagaauuuaaagacgcccacgccaaaagacaaaccgucgucguccucggcagccaagaaggggccguccacaccgcucuagccggggcccucgaagcagagauggacggagccaagggacggcuaagcuccggccaccuaaaaugcagacucaagauggacaaacuaaggcucaagggggucucauacagcuuaugcacagccgcauucacauucaccaaaaucccggcagagacauuacacggcacagucaccgucgaaguacaauacgcaggcacagacggcccaugcaaagucccagcccaaauggcgguagacaugcaaacacucacccccgucggccgccuuaucacagccaacccagucaucaccgaaagcacggaaaacagcaagaugaugcucgaacucgacccacccuucggcgacucguacauaguaaucggagucggagagaaaaagauaacccaucacuggcaccgcagcggcuccaccauaggcaaagccuucgaagcgaccguacgcggcgcaaaacggauggccguacucggcgacacugccugggacuucggaucaguaggcggcgcccucaacucacuaggcaagggaauccaccaaaucuuuggcgcagccuucaaaagccuauucggcggaaugucgugguucagccaaauccucauaggcacguuacucauguggcucggccuaaacaccaaaaacggcuccaucucccuaaugugccucgccuuaggcggaguccugaucuuccucagcacagcaguaucggccgacguaggaugcuccguagacuucagcaaaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9469 - RNA, 2365 nt, Artificial Sequence
  KU312312.1 prME-long mRNA Design 3 opt
gggagaaagcuuaccaugagaauaauaaacgcgcgcaaagaaaagaaacgacgcggcgcagacacaagugucggaaucgucggccuccugcugacgacagccauggcugcagaagucacacgcagaggaagcgccuacuacauguaccuagaccgaaacgacgcaggcgaagccauaucauucccaacaacgcucggcaugaacaaaugcuacauucaaauaauggaccuagggcacacaugcgacgcaacgaugagcuacgaaugccccaugcucgacgaaggagucgaaccagacgacguagacugcuggugcaacacgaccagcacgugggugguauacggaaccugccaccacaagaaaggggaagcacgaagaucacgacgcgccgugacccuccccagucacagcacacgaaaacuccaaacacgcucccaaacauggcuagaaucacgcgaguacacgaaacaccucauccgagucgaaaacuggaucuuuagaaacccaggcuuugcacucgcagcggccgccauugcauggcuacugggcaguagcacaucccagaaaguuauauaccucguaaugauacuucuaauagcgcccgcauacuccauccgcugcauaggaguguccaauagagacuucguagaaggaaugagcggaggcaccuggguagacguagucuuagaacacggaggcugcgucacagucauggcccaagacaaaccgaccguagauauagaacucguaaccaccacagucagcaacauggcagaagugcgaucauacugcuacgaagccucaaucuccgacauggccagcgacagccggugcccaacacaaggagaagccuaccucgacaaacaaucagacacccaauaugucuguaaacgcacacucgucgacagaggguggggaaacggcugcggccucuucggcaaagggucacucgucacgugcgcaaaauucgcaugcagcaagaaaaugacgggcaaauccauccaacccgaaaaccucgaauaccgaauaaugcucagcguccacgggucacaacacagcggaaugauagucaaugacaccggacacgaaacagacgaaaacagagcaaaaguagaaaucacaccaaacucaccgcgagccgaagccacacugggaggauucgggagucucggccucgacugcgaaccccggacuggccuagacuucuccgaccuauacuaccuaacgaugaacaacaaacauuggcucguccacaaagaaugguuccacgacaucccacucccguggcacgccggcgccgacaccggcacuccccacuggaacaacaaagaagcccuugucgaguucaaagacgcccacgcaaaacggcaaacaguaguagucuuagggucacaggagggcgccguucacaccgcccucgcuggggcgcuugaggccgaaauggacggcgccaaaggccgccucuccagcggacaccugaaaugccgacuuaaaauggacaaacuacgacuaaaaggagucuccuacagccucugcacagcagccuucaccuucacgaagaucccagccgaaacacuacacggaacagucacaguagaaguacaauacgcagggaccgacggcccaugcaaaguccccgcccaaauggccguagacaugcagacacuaacgcccguaggaagacucaucacagcaaacccgguaaucaccgaaagcaccgaaaacuccaaaaugaugcuggaacucgaucccccauucggagacagcuacauagucaucggaguaggagaaaagaaaauaacacaccacuggcaccgcagcggaucaaccauaggaaaagccuuugaagccaccguaagaggcgcaaaaaggauggcgguucugggggacacagcaugggacuucggcuccguaggcggcgcacuaaacucccucggcaaaggaauacaccaaaucuucggagcagccuucaaaucucucuucggcggaaugagcugguucagccaaauccuaauaggcacgcuacucauguggcuaggacuaaacgccaagaacggauccaucagccuaaugugccuggcucucggcggcguguuaauauuccuuagcacagcagucuccgccgacguaggcugcagcguagacuucuccaaaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9470 - RNA, 2353 nt, Artificial Sequence
  AY632535.2 prME-long mRNA Design 3 opt
gggagaaagcuuaccaugcgcaucauaaacgcgcgcaaagaacgcaaacgaagaggcgcagauacaagcauaggaauaaucggacuccugcucacaacagcgauggcagcagagaucacacgaagggggucagccuacuacauguaccucgacagguccgacgcaggaaaagcaauaucauucgcaaccacacuaggagucaacaaaugccacguacaaaucauggaccuaggacacaugugcgacgccacaaugucguacgaaugcccgaugcuggacgaaggaguggaaccggacgacguagacugcuggugcaacacaacaaguacguggguggucuacggaacgugccaccacaagaaaggagaagcccgacgaagcagacgagcaguaacacugcccagccauucaacaagaaaauugcaaaccagaucccagacauggcuggaaagcagggaauacaccaaacaccucauaaagguagaaaacuggauauuccgaaaucccggauucgcacucguagccguagcaauagccugguuacugggcucaagcacaagccaaaaaguaauauaccuagugaugauacuccugaucgcccccgcguacucgauccgaugcauaggagucagcaaccgggacuuuguugaagggaugucaggaggaacauggguagacgucgugcucgaacacggaggcugugugacaguaauggcgcaagacaaacccacggucgacauagagcuaguaacaacaacuguaagcaacauggcagaagugagaagcuacugcuacgaagccucgaucucagacauggcaagcgauagccgaugcccuacgcaaggagaagccuaccuggacaaacagucagacacccaguacgucugcaaacggacacuggucgaccgcggcuggggcaacggcugcggccucuucgggaagggaucacucgugaccugcgcaaaguucacgugcagcaagaaaaugaccggcaaaagcauacaaccagaaaaccuagaauaccgaaucaugcucucaguacacggcucgcaacacucaggaaugaucggauacgaaacagacgaagaccgagcaaaaguagaagucacuccaaacagcccgcgcgcagaagcaacacuagggggcuucgggagccucgggcuagacugugaaccacgcacgggacuggacuucagcgaccucuauuaccuaacgaugaacaacaaacacuggcugguccacaaagaaugguuccacgacaucccacuuccguggcacgccggagccgacaccggcacaccccacuggaacaacaaagaagcccuagucgaguucaaggacgcccacgcuaaaagacaaaccgucgucguccucggcucacaagaaggagcgguccacaccgcgcucgcgggcgcucucgaagcggagauggacggugccaaaggacgcuuauucuccgggcaccuaaagugcaggcuaaaaauggacaaauuaagacucaaaggaguauccuacucgcucuguaccgcagccuuuaccuucacaaaggucccagccgaaacccuacacgggacagugacaguugaaguccaguacgccggcacagacggaccaugcaaaaucccgguacagauggcgguagacaugcaaacauugacaccagugggacgccucauaacugcuaacccaguaauaacagaaucaaccgaaaacaguaaaaugaugcuggagcuggacccgccauucggagacagcuacaucgugauaggaguaggagacaagaaaauaacacaccacuggcacaggagcggcagcaccaucggaaaagcauuugaagcgacagucaggggcgcgaaaagaauggcaguacuaggggacaccgcaugggacuuugggagcgugggaggaguuuuuaacagcuuaggaaaaggcauccaccagaucuucggagccgcauucaagagcuuguucggaggcaugagcugguucagccaaauacuaauagggacccuccuggucuggcuugggcugaacaccaaaaacggaagcaucagccugacaugccucgcacuaggaggcguaaugauauuccuaagcacagccgugagcgcggacguggggugcagcguggacuucagcaaaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9471 - RNA, 2365 nt, Artificial Sequence
  KU527068.1 prME-long mRNA Design 3 opt
gggagaaagcuuaccaugcgaaucauaaacgcacggaaagaaaagaagagaagaggagcagacaccagcguagggaucgugggccugcuccucacaacggccauggccgccgaagucacccgcagaggaucagcuuacuacauguaccuagaccgcaaugacgcgggcgaagcaaucagcuuccccacgacccuaggcaugaacaaaugcuacauacaaauaauggacuuaggccacaugugcgacgcaaccaugaguuacgaaugcccgaugcuggacgaaggggucgaaccagacgacguagacuguugguguaacaccacaucaacaugggugguguacgggaccugccaccacaagaaaggcgaagccaggcgaucgagacgagcuguaacccuaccaagccacagcaccagaaaacuacaaacgagaucacaaacguggcuggagucacgcgaauacaccaaacaccucauccgaguugagaacuggauauuccgaaacccggguuucgcauuggcagcggccgccaucgccugguuacucggaagcucuacgagccaaaaggucaucuaccuaguaaugauccuccucauagcaccagcauacagcauccgcuguauuggcgucagcaacagggacuucguagaaggcaugagcgggggcacaugggucgacguaguacuugaacacggcggcugcgucaccguaauggcacaagacaaacccacagucgacaucgaacucguaacaacgaccguaagcaacauggcggaagugcgaagcuacugcuacgaagcaucaaucagcgacauggcgagcgacagcagaugcccuacccagggcgaagcauaccucgacaaacaaagcgacacacaauacguaugcaagagaacucuagucgaccgaggguggggcaacggaugcggacuauucggaaaaggcagccucgucacaugugcaaaauucgccugcucaaagaaaaugacagguaaaagcauacaacccgaaaaccuggaguaccgcauaaugcuaagcguacacgggucccaacacagcggcaugauagucaacgacaccggacacgagacagacgaaaaccgagccaaaguggaaauaaccccaaacagcccaagggcagaggccacccuaggaggguucggcagccucggccucgacugcgaaccacgcaccggccuagacuucucagaccuauacuaccucacaaugaacaacaagcacuggcucguacacaaagaaugguuccacgacaucccccuuccauggcacgcgggagccgacaccggaacgccccacuggaacaacaaggaagcgcucguggaguucaaagacgcccacgcaaaacgacaaaccgugguaguccuaggaagccaagaaggggcaguacacaccgcacucgccggagcacuagaagcggaaauggacggagcgaaagggagacucagcagcggacaccugaaaugucgacucaaaauggacaagcuacggcugaagggagugagcuauucccucugcacagcagccuucacauucacaaaaaucccggccgaaacacuacacggaaccgucacuguggagguacaauacgccggcacagacggccccugcaagguaccagcccaaauggcaguagacaugcaaacacucacaccagugggccgccuaauaacggcaaauccaguuauaaccgagagcacggaaaacuccaagaugaugcucgaacucgaucccccguucggagacucauacauaguaauaggcguaggggagaaaaagaucacccaccacuggcacagauccggcucgacaauaggaaaagccuucgaagccaccguacgcggagcaaaaagaauggcgguacuaggagacacagcaugggacuucggauccgugggcggagcccuaaacucccucggaaagggaauacaccagauauucggagcggcauucaaaucccuauucggaggaaugagcugguucagccagauccucauaggaacacuacuaauguggcuaggucucaacaccaaaaacggaagcauuagccucaugugccucgcacuaggcgguguacuaauuuuccuaagcacagccguaucagcggacguaggaugcagcguagacuucuccaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9472 - RNA, 2365 nt, Artificial Sequence
  KU720415.1 prME-long mRNA Design 3 opt
gggagaaagcuuaccaugcggaucauaaacgccaggaaagaacgaaaacggagaggagcagacacgagcauuggcaucaucgggcuacuacuaacgaccgcgauggcggcggagaucacacgaagaggaagcgcauacuacauguaccuggacagguccgacgccggaaaagccauuucauuugccacaacacuagggguaaauaagugccacguacaaauaauggaucuuggacacaugugcgacgcaacaauguccuacgaaugcccaaugcuggaugagggcguagaaccagacgacgucgacugcuggugcaacacgacaucgacgugggucguauacggaacaugccaccacaagaagggggaagcacgaagaucgcggagagcaguaacacucccgagucacucgacacggaagcuacaaacaaggagccaaacauggcuggaguccagagaauacacaaagcaccuaauaaaagucgaaaacuggaucuuccgcaaccccgguuuugcccuagucgcagucgcaauagccuggcuacuaggcucaagcaccagccagaaaguaauauaucuagugaugauacuccugauagcgccagcguacagcauuaggugcauaggaguaagcaaccgcgacuucguagaaggcaugucgggcgggaccugggucgacgucguauuagaacacggaggcugcgucaccguaauggcacaggacaaaccaacaguagacaucgaacucguaaccaccacagucagcaacauggcggaggucagaagcuacuguuacgaggcaucuauaagugacauggccagugacagccgcuguccaacacaaggagaagcauaccuagacaaacaaucagacacacaauacgucugcaagagaacccuaguagaccggggaugggggaacgggugcggacuuuucggcaagggcucgcucguaacaugcgcaaaauucacgugcucgaagaaaaugacgggcaaaagcauccaaccagaaaaccucgaauacaggauaaugcuaucggugcacggcucacaacacucaggaaugauaguaaacgacaccggauaugaaacagacgaaaaccgggcaaagguagagguaacaccgaacagcccccgggcagaggcgacacuaggcggcuucggaagccuaggcuuagacugcgaaccaagaacaggccucgacuucucagaccucuacuaccuaaccaugaacaacaaacacuggcucguccacaaagagugguuccacgacauaccgcucccauggcacgcgggagccgacacaggaacaccgcacuggaacaacaaagaggcccuaguagaguucaaagacgcacacgcaaaaagacaaacaguaguagugcuaggcagccaagaaggcgccgugcacacagcccucgccggagcgcuggaagccgaaauggacggcgcgaaaggcaaacuguucuccggacaccuaaagugccggcucaaaauggacaagcugcgacucaagggcguaagcuacucccuguguacagcagccuucacauucacaaaagugccggccgagacccuacacgggaccgugacaguagaagugcaauacgccggaacagacggccccugcaagaucccgguacaaauggcagucgauaugcaaacacuaacacccgucgggagauugauaaccgcaaaccccguaauaacagaaaguacagagaacaguaaaaugaugcuagaacuggacccgcccuucggcgacagcuacauagucaucggcgucggagauaagaaaaucacacaccacuggcaccgaagcgggagcacaauagggaaagcguucgaggcaacagucaggggagcgaaacggauggccguacuaggcgauaccgcgugggacuucggaagugucggcggcguauucaacucacuagggaaaggaauccaccaaaucuucggagcagccuucaagagccuauucggcggcaugaguugguucucacaaauacugauaggcacacugcugguauggcuagggcuaaauaccaaaaacgggagcauaagccuaaccugccucgcacucgguggcgugaugaucuuccugagcacagccguaagcgcggacguagggugcagcguggacuuuagcaaaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9473 - RNA, 2347 nt, Artificial Sequence
  DQ859059.1 prME-long mRNA Design 3 opt
gggagaaagcuuaccaugagaaucaucaacgccaggaaagagcgaaaacgucguggagcagacacaucgauaggcauagucggccuacugcucacaaccgcaauggccgcagagauaacacgcagaggcucagcauacuacauguaccucgaccgaagugacgccggaaaagcaaucucauucgcaacaacacuaggcguaaacaaaugccacguacaaauuauggaccuaggucacaugugcgacgccaccaugucauacgagugcccgaugcuagacgaaggcguggaaccagacgacguagacugcuggugcaacacaacgagcaccugggucguauacgggacgugccaccacaagaaaggcgaagcaagacgaagccggcgcgccgugacacucccaagccacagcacccgaaaacuacagaccagaagccagacuuggcuagaaagccgagaauacaccaaacaccucaucaaaguagaaaacuggaucuucagaaacccaggguucacgcucguagccguagccauagccuggcucuuaggcucaagcacgucgcaaaaagucaucuaccuagugaugauacuccugauagcgcccgccuacagcauacgaugcaucggagucagcaaccgcgacuucguggagggcaugucaggagggaccugggucgacguaguccuggaacacggaggcuguguaacaguaauggcccaggacaaaccaacagucgacaucgaacucguaaccaccaccguguccaacauggcagaagucagaucuuacugcuacgaagccagcaucucagacauggccucagacucacgcugucccacacaaggagaagcguacuuagacaaacaaucagacacccaauacguaugcaaacgcacgcucgucgaucgagguuggggaaacggcugcggacuauucggcaaaggcucgcucguaaccugugcaaaauucacaugcagcaagaaaaugacaggcaaaagcauccaaccggaaaaccuagaauaccggaucaugcucucgguacacggcucccaacacagcggaaugauagucaacgacgagaaccgcgcaaaaguagaagucaccccaaacucuccccgcgcagaagcaacccuaggaggguucggaucccuaggcuuggacugcgaacccagaacaggacucgacuucagcgaccucuacuaccuaacaaugaacaacaagcacugguugguucacaaagaaugguuccacgacaucccucucccauggcaugcgggggcagacacagggacgccucacuggaacaacaaagaagcccuagucgaguucaaagacgcgcacgcaaaacgccaaacggucguaguacucggcagccaagaaggcgcgguccacaccgcgcuagccggcgcucucgaagcggaaauggacggagcaaaaggacgccuauucuccggccaccucaagugccgacuaaagauggacaaacuacgauugaaagggguauccuauucccucugcacagcagcauucaccuucaccaagguccccgccgaaacccuacacggcaccgucaccgucgaagugcaauacgcaggaaccgacggcccgugcaaaguccccgcacaaauggccgucgauaugcagacacuaacaccgguaggacgacugaucacugcgaaccccgugaucaccgaaagcaccgaaaacucaaaaaugaugcucgaacuagacccuccguucggcgacagcuacaucgucaucggggucggcgacaagaaaauaacccaccacuggcaccgcagcggaucaacuaucggcaaagcguucgaggccaccguaagaggcgccaaacggauggcaguacuaggcgauacagcaugggauuucggguccguaggaggcgucuucaacagccucggaaaaggcauccaccaaauauucggcgccgcguucaagagccuauuuggcggaaugagcugguucucacaaauccugaucggaacucuccuagucuggcuaggacuaaacacgaaaaauggaucaauaagccuaacaugccuggcacuaggaggcgucaugauauuccuaaguacagcagucagcgccgacgucggaugcagcguagacuucagcaaaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9474 - RNA, 2365 nt, Artificial Sequence
  KX377335.1 prME-long mRNA Design 3 opt
gggagaaagcuuaccaugcgcaucauaaacgcgagaaaagaacgaaaacgccgcggggcggacacgagcaucggcauaaucggacuguugcuaacgaccgcgauggccgcggagaucacaagacgaggcagcgcguacuauauguaccucgaccgguccgacgccggaaaagccaucucguucgccaccacccuaggagucaacaaaugccacguccaaauaauggaccucggccacaugugcgaugccacaaugucauacgagugccccaugcuagacgaagguguagaaccagacgacguagacugcuggugcaauaccacgagcacguggguaguuuacggcacgugucacagaaagaaaggagaagccaggagaucaagacgcgcggucacccucccaagccacucaacacgcaaauuacagaccagaagccagaccuggcucgaguccagagaauacaccaaacaccugauaaaagucgaaaacuggaucuuucgcaaccccggauucgcacucguggcaguagcgauagcauggcuccuaggcagcagcacaucccaaaaagugauuuaucucgucaugauccuacugauagcaccggcguacagcaucaggugcauaggaguaaguaacagggauuuuguagaaggcaugucuggcggaacguggguagacgucguacucgagcacggaggcugugucacagucauggcccaagacaaacccacagucgacaucgagcucgucaccacgacagucagcaacauggcagaagugcgaucauacugcuacgaagcgucgaucagcgacauggcauccgacucgcgcugccccacgcaaggugaagcauaccuagacaagcaaucagacacacaauaugucugcaaacgcacccucgucgaccgaggauggggcaacggaugcggacucuuuggaaaaggaucccuaguaaccugcgccaaauuuaccugcagcaaaaagaugacgggcaagagcauccaacccgaaaaccucgaguacagaaucaugcuguccguccacggcucgcaacacucaggaaugauagucaacgacacaggcuacgaaacagaugaaaacagggcaaaagucgaagucacccccaacuccccacgcgcggaagccacccugggcggauucggcucccuaggccuagacugcgaaccacgcacaggacucgacuucagcgaccuguacuaccuaacaaugaacaacaaacacuggcuaguccacaaggagugguuccacgacauaccacuccccuggcacgcaggcgccgacaccggaaccccgcacuggaacaacaaagaagcacucgucgaguucaaagacgcacacgcaaagagacaaacgguaguaguccugggaucccaagaaggcgcaguacacacagcacuggccggcgcccuagaagccgaaauggacggcgcgaaaggaaaacuguucagcggccaccucaaaugccgccuaaaaauggacaaacuacgacucaaaggaguaucuuacucccuauguaccgcagccuucaccuucaccaaaguaccggccgaaacgcuccacggaacugugacagucgagguacaauacgccggcaccgacggacccugcaaaauaccaguacaaauggccguagacaugcaaacgcuaacgcccguaggacggcuaaucacagcgaaccccgugauaacagaaucaaccgagaacucaaaaaugaugcucgaacuagacccgcccuucggcgacagcuauauagugauaggcguaggcgacaagaaaauaacccaccacuggcacagaagcggauccaccaucggcaaagcguucgaagcaaccguaaggggcgccaaaagaauggcaguccuaggagauaccgccugggacuucggaagcgucggaggagucuucaacagccuuggaaaagggauucaccaaaucuucggagccgccuucaaaagccuauucgggggcauguccugguucagccaaauacuaaucggcacccuauuagucuggcucggccucaauaccaaaaauggcagcauuagccuaaccugccuagcacucggaggcgucaugaucuuccugagcacagccguaagcgccgacguaggcugcuccguagacuucuccaaaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9475 - RNA, 2365 nt, Artificial Sequence
  LC002520.1 prME-long mRNA Design 3 opt
gggagaaagcuuaccaugcgcauaaucaacgccagaaaagaacggaaacgacgaggcgcggacacaucaauaggaaucauaggacugcugcugacaacagcgauggcggccgagauaacaagacgaggcucggccuacuacauguaccucgaccggagcgacgcagggaaagcgauaucauucgcaacgacacucggaguaaacaagugccacguacaaaucauggaccucggacacaugugcgacgccacgaugucauacgagugccccaugcuggacgagggcgucgaaccagacgacguagacugcuggugcaacaccacaagcacauggguaguauacggaaccugccaccacaagaaaggcgaagcgcgaaggucaagacgagcagucacccuaccaagccacagcacaagaaaacuccaaacccgcucacaaaccuggcuagaaagccgagaauauaccaaacaccucaucaaaguagaaaacuggauauuccgcaacccaggcuucgcacucguggcaguagccauagcaugguuauuaggcaguagcacuagccaaaagguaaucuaccuagucaugauacuccuaaucgcgcccgcguacucaaucagaugcaucggaguaagcaacagagacuucguagaagggaugucagggggaacauggguagacgucguacuagaacacggaggaugcgucacgguaauggcccaggacaagccaaccgucgacauagagcucgugaccacuaccguaagcaacauggcggaaguacgaucauauugcuacgaagccucaauaucagacauggccucugacagccgcugcccaacacaaggagaagcguaccuagacaagcaaagcgacacgcaauacgucugcaaacggacacucguagaccgcggauggggaaacggcugcggucuauucggaaagggcucgcucguaaccugcgcaaaauuuaccugcucaaagaaaaugacaggcaaaucaauucagccggaaaaccucgaguacaggaucaugcucuccguacacggcucacaacauagcggcaugacagucaacgacauaggauacgaaacugacgaaaacagggccaaagucgaaguaacgcccaacagcccaagagcagaagccacacugggaggauucggcagcuuaggccuggacugcgaaccgcgaaccggauuggacuucucagaccucuacuaccuaaccaugaacaacaaacacuggcuaguccacaaagaaugguuccacgacauaccacuaccguggcacgcaggcgcagacaccgggaccccgcacuggaacaacaaagaagcgcuggucgaguucaaagacgcgcaugccaaacgacaaaccgucguggucuuaggaucccaagaaggcgcgguccacacggcacuggcaggcgcucucgaagccgaaauggacggagcaaaaggaaagcuauucagcggccaccucaaaugcagacucaaaauggauaaacugaggcucaaagggguaucguacucccugugcacagcagccuucaccuucacaaaaguccccgcagagacccuccacggcacagugacaguggaaguccaauacgccgggacagacggaccaugcaaaaucccaguccagauggcaguagauaugcaaacacugacacccguaggaagacuaaucacggcaaaccccgugauaacagaaucgacagaaaacuccaaaaugaugcuggaauuagacccacccuucggcgauagcuacaucguaauaggagucggggacaagaaaauaacacaccacuggcaccgcagcggaagcaccaucggcaaagcauucgaggcgacggucagaggcgcaaaacgaauggcggucuuaggagacacagcaugggacuucggguccgugggagggguguucaacucacuaggaaaaggaauccaucaaaucuucggagccgcauucaaaagccuauucggagggauguccugguucucacaaauacuaauaggcacacugcugguauggcuaggacucaacaccaaaaacgggagcauaagccuaaccugccucgcacuagggggaguuaugaucuucuugagcacggccgucagcgcagacgucggcugcucaguagacuucagcaaaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9476 - RNA, 2353 nt, Artificial Sequence
  KU963573.2 prME-long mRNA Design 3 opt
gggagaaagcuuaccaugcgcauaaucaacgcccgcaaagaacgcaaacgaagaggcgcagacacaagcauaggcaucaucggccuccuccucacaaccgccauggcagcagaaauaacccgcagaggaagcgccuacuacauguaccuagaccgcuccgacgcaggcaaagccauaucauucgcaacaacccugggaguaaacaaaugccacguccaaauaauggaccugggccacaugugcgacgccacgauguccuacgaaugcccaauguuagacgaaggaguagaacccgacgacgucgacugcugguguaacacaacuagcacauggguagucuauggaaccugccaccacaagaaaggagaagcaagacgaucccgccgcgcggugacccugccaagccacucaacacgaaaacuacaaaccagaucccaaaccuggcucgaaucacgugaauacaccaaacaccucauaaaggucgagaauuggauauuccgaaacccaggcuucgcccuaguagcaguagcaauagcauggcugcucgggaguagcaccagccaaaaggucaucuaccuagucaugauacuacucauagccccagcauacagcauccgaugcauaggaguauccaaccgcgacuucguagaagggaugagcggaggcaccuggguagacguaguccucgaacauggaggaugcguaacgguaauggcacaggacaagcccacggucgacauagaauuagugacgaccacaguauccaacauggccgagguacgaaguuacugcuacgaagcgucaauauccgacauggcgagugacucgcgcugccccacacaaggggaggcuuaccucgacaaacagagcgacacacaauacgucugcaaacgaacccuagucgaccgcggaugggguaacggcugcggacuauuuggcaaaggcagccuagugaccugcgccaaauucacauguuccaaaaagaugacuggaaaauccauacaaccagaaaaccucgaauaccgcaucaugcuauccguacacggcucacaacauucaggcaugauaggguacgaaacagacgaaaaccgcgccaaaguagaagucacaccaaacagcccaagagcagaggccacacuaggaggcuucggaucccucggacucgacugcgagccgcgaaccggccucgacuucucggaccuauacuaccucacaaugaacaacaaacacuggcucguccacaaagaaugguuccacgacaucccccugccauggcacgcaggcgcagacaccggaacaccgcacuggaacaacaaagaagcacugguagaguucaaagacgcccaugccaaacgccaaacaguaguaguucugggaucccaagaaggcgcaguccacacugcccucgcgggcgcccucgaagcagaaauggacggcgcuaaaggcaaacuauucuccgggcaccucaaaugucgacuaaaaauggacaaacuccgacuaaaaggcguaagcuacucucucugcaccgccgcguucacguucacaaaaguccccgccgaaacacuccacggcacagucaccgucgaaguccaauacgccggaaccgacggacccugcaaaauacccgugcagauggcaguagacaugcaaaccuuaacaccagucggacgccucauaaccgcaaacccagucaucacagaaagcaccgaaaacuccaaaaugaugcuagaacucgacccgcccuucggcgacuccuacaucgugauaggcgugggggacaagaaaaucacacaccacuggcaccgaagcggcagcacaaucggaaaagccuucgaggccacagucagaggcgcaaaaagaauggccgugcuaggagacaccgcaugggacuucgguuccguaggcggcguauucaacagccucggcaagggaauccaccaaaucuucggcgcggcuuucaaaagccucuucggcggcauguccugguucucacagauccugaucggcacacuccucgucuggcuaggccuaaacaccaaaaacggcucgauaaguuuaacaugccucgcacugggcggagucaugaucuuccucucaaccgcaguuagcgccgacguaggaugcagcguagauuucuccaaaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9477 - RNA, 2365 nt, Artificial Sequence
  KX694534.2 prME-long mRNA Design 3 opt
gggagaaagcuuaccaugagaaucaucaacgcacgaaaggaaaagaaacgcagaggagcagacacaagcgucggcauaguaggacuccuacuaacaacagccauggccgcagaagucacaagaaggggaagcgcauauuacauguaccucgaccgcaacgacgcuggcgaagccaucagcuucccgaccacccuaggcaugaacaaaugcuauauacaaauaauggaccucggccauaugugcgacgcaacaaugagcuacgaaugccccaugcucgacgaaggcgucgaaccagacgacgucgacugcuggugcaacacaaccucaacaugggucgucuacggcacgugccaccacaaaaagggagaagccagacgcucccgacgagccguuacccucccuagccacagcacgagaaaacuccaaacacgaucacaaaccuggcuugaaagccgcgaauacaccaaacaccucauccgcguggaaaacuggauauuccgaaaucccggcuucgcccucgcagcagccgcgaucgcauggcuccuuggcuccuccacgucccagaaagucaucuaucucgucaugauccuacuuaucgcgccugcauacuccauaagaugcaucggcguaagcaacagagacuucgucgaaggcauguccggcggcaccugggucgacgucguccuagaacacggggguugcguaaccgucauggcucaggacaaaccaacagucgacaucgaacugguaacaacgaccgucagcaacauggccgaaguacgcagcuacugcuaugaggcuucaauaagcgacauggccagcgacagccggugcccaacacaaggagaagccuaccuagacaaacaaucagacacccaauacgucuguaagagaacccugguggaccgcggauggggaaacggcugcggauuguucggcaagggcucccuaguaacaugcgcaaaauucgccugcuccaagaaaaugaccggcaaaucgauccaacccgaaaaccucgaauaccgcauaaugcuauccguccacggcucacaacacucaggcaugauaguaaacgacaccggacacgaaacagacgaaaauagagcgaaaguggagaucacucccaacagcccaagagcggaagccacacuaggaggcuucggcucccuaggacucgacugugaaccacgaaccggacucgauuucucggaccucuacuaccuaacaaugaacaacaaacacuggcucgugcacaaagaaugguuccacgacauaccccucccuuggcacgcaggagcagacaccggcaccccacacuggaacaacaaagaagcccucguagaguucaaagacgcccacgccaaaagacaaacaguuguaguacugggcagccaagaaggagccgugcacaccgcccuagccggagcccuagaagccgaaauggacggggcuaaaggccguuuauccagcggccaccuaaaaugcagacuaaaaauggacaaacuaagguuaaaaggcguaagcuacucccuaugcacggcggcauucaccuucacaaaaauccccgcagaaacccuccacggaacagucacaguggaaguucaauacgccggcacagacggacccuguaagguaccagcacaaauggcugucgacaugcagacucugacaccaguugggcgacucaucaccgcaaaccccgucaucacugaaagcaccgaaaacuccaagaugaugcuagaacuugacccaccauucggagacagcuacauaguaauuggcgucggcgaaaagaaaaucacacaccacuggcacagaagcggcagcacgauagguaaagcauucgaagcaaccguaaggggcgccaaacgaauggcagugcucggagacaccgccugggacuucggaagcguaggaggcgcccugaacucacuaggccgaggcauacaucaaauauucggggcagcauucaaaagccucuucggcggcaugagcugguucagucaaauacuaauagggacacugcuaauguggcuaggacugaacaccaaaaacggcucaauaucacuaaugugccuagcacucggaggcgugcuaauauuccuaagcacagcagucucggcagacguaggaugcagcguagacuucuccaaaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9478 - RNA, 2365 nt, Artificial Sequence
  KX447520.1 prME-long mRNA Design 3 opt
gggagaaagcuuaccaugcgcaucaucaacgcaaggaaggagaaaaagcgacgaggcgcagacgcgagcgucggcauaguaggccuccugcucacaaccgcgauggccgccgaggucacacgcagaggcucggccuauuacauguaccucgacagaaaugacgcaggcgaagccaucucauucccgaccacacucggaaugaacaaauguuacauacaaaucauggaccuagggcacaugugcgacgcaacuauguccuacgaaugcccgaugcucgacgaaggaguagaaccagacgacguagauugcuggugcaacacaacaagcacauggguagucuauggcacgugccaccacaaaaagggggaggcgaggaggagcagaagggcaguuacacucccaagccacagcacgcgcaaacuacaaacaaggagccagaccuggcuugaaagcagagaauacacaaagcaccugaucagggucgaaaacuggauauuccgcaacccggguuucgcacuagcagcagcagcaaucgcauggcuccuaggaagcagcacgucccaaaaaguaauauaccucguaaugauacugcucaucgccccagcuuauucaaucaggugcaucggcgugagcaacagagacuuuguggaaggaaugucaggcggcacgugggucgacgucguucuagaacacggaggaugcgucacaguaauggcucaggacaaaccaacagucgacauagagcuaguaacaacaaccguaagcaacauggcagaaguucgcaguuacugcuaugaagccucgaucucagacauggccucagacucgagaugccccacacaaggagaagcguaccuagacaaacaaucagacacccaauacguaugcaaaaggacccuaguagaccgcggaugggggaacgggugcggacuauucggaaagggaucgcucguaaccugcgcaaaauucgccugcagcaaaaagaugacuggcaaaagcauacaacccgaaaaccuggaauacagaaucaugcuaucaguccacgggagccaacacucaggcaugauaguaaacgacacgggccacgaaacagacgaaaacagagcuaaaguagagauaacacccaacagcccacgagcggaagcgacacuaggagguuucggaagccuaggccuggacugcgaaccgcgaacaggccucgauuucagcgaucucuacuaccugaccaugaauaacaaacacuggcucguacauaaagagugguuccacgacauaccgcuaccauggcaugccggagcagacaccggaacaccccacuggaacaacaaagaggcccuagucgaguucaaagacgcgcacgccaaaagacaaacaguggugguacugggaucgcaggagggcgcgguccacacugcacucgccggcgcgcuagaagccgagauggacggagcaaaaggacgccuaagcagcggacaccucaagugccgacuaaagauggacaagcuccgccuaaaaggggucucguacagucucugcacggcagcauucaccuucacgaagaucccggcggaaacacugcacggaaccguaacaguagaagugcaauacgccgggaccgacggcccgugcaaagucccggcccaaauggcaguagacaugcaaacgcuaacaccaguaggaagacugaucacugccaacccaguaaucacagaaucgacagagaacucaaaaaugaugcuagaauuggacccgcccuuuggcgacagcuacaucgugauaggaguaggggaaaagaaaauaacacaccacuggcaccgaagcggaagcacaaucgggaaagccuucgaggcaacaguccgaggcgcaaagagaauggcaguccuuggagacacggcaugggacuucggaagcgucgggggcgccuugaacucacuaggcaaagggauccaccaaauauucggagccgcguucaagagccucuucggcggcauguccugguuuucacaaauacucaucggaacauuacugauguggcucgggcuuaacaccaagaacggcucaauaagccugaugugccucgcccuagggggcguacucauauuccuguccacggccgucagcgccgacguaggaugcagcguagauuucagcaaaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9479 - RNA, 2365 nt, Artificial Sequence
  KX369547.1 prME-long mRNA Design 3 opt
gggagaaagcuuaccaugcgaaucaucaaugcacggaaagagaaaaagcgccgaggggccgacacgagcgucgggaucguaggccuacugcugaccaccgcaauggccgcagaagucacacgacgaggcagcgcauacuacauguaccucgacagaaacgacgccggagaagccaucucauuccccacaacacucgggaugaacaaaugcuacauccaaauaauggaccuaggacacaugugcgaugcaaccaugagcuacgaaugcccaaugcucgaugaaggcguugaaccagacgacguggacugcuggugcaacacaacuagcaccugggucgucuacggcacaugccaccacaagaaaggggaggcacgcagaagucgacgggccguaaccuuacccagccacuccacaagaaaacuacaaacacgcucacaaaccuggcuggaaagucgagaauacaccaaacaccucauccgaguggaaaacuggaucuucagaaacccgggacuagcacuagccgccgcagcaaucgcauggcuacuaggaagcuccacaagccaaaaagucauauaccucgucaugauccuacugaucgccccagcauacaguauacgcugcauaggagugagcaacagagacuucguagaaggcaugucaggaggaacgugggucgacguaguccucgagcacggcggcugcguaaccguaauggcacaagacaaacccaccguagacauagaacucgucaccacaaccguuagcaacauggcagaggucaggucuuacugcuacgaagcaagcauaagcgacauggcauccgacucaagaugccccacccaaggcgaagcauaccuagacaaacaauccgacacacaauacguaugcaaacgaacccuaguagaccggggcuggggcaacggcugcggacuauucggcaaagggagccuagucacaugcgcaaaauucgcauguuccaagaaaaugaccggcaaauccauccaaccagagaaccucgaguaccgcauaaugcugucaguacacggcucccaacacuccggaaugauagugaacgacaccggccacgaaaccgacgagaacagagccaaagucgaaauaacacccaacucaccccgggcagaggcaacccucggaggcuucggcagucucggacucgacugcgaaccccguaccggucucgacuuuucagaccuauacuaccuuacuaugaacaacaaacacuggcuagugcacaaagagugguuccacgauaucccccuaccauggcacgccggggccgacaccggcacaccacacuggaacaacaaagaagcgcucgucgaguucaaagacgcgcacgcaaagcgccaaaccgugguaguccuaggcagccaagaaggggcaguccacacagcacuagccggagcgcuggaagcagaaauggacggagccaaaggccgccuauccagcggacaucuaaaaugcagacuaaaaauggacaaacuccgucucaaaggaguauccuacagccucugcacagcagcuuucaccuucacgaagauccccgccgaaacccuccacggcacagucacagucgaaguccaguaugccggaacagacggaccaugcaaagugccggcccaaauggccguggacaugcaaacacuuaccccaguaggccggcuaaucacagcaaacccagugaucaccgaaagcaccgaaaacuccaaaaugauguuagaacuggacccacccuucggcgauuccuacaucgucaucggcgugggcgaaaagaaaaucacacaccauuggcaccgaagcggcuccaccaucggaaaggcauucgaagccaccguaagaggcgccaagcgcauggcaguacuaggagacacagcgugggacuucggcagcgucggaggagcucuaaacagccugggaaaggguauacaccaaaucuucggagcggccuucaaaagccucuucgggggcaugucaugguucagccagauccuaaucggaacccuacuaauguggcucggccuaaacaccaagaacggaagcauaucgcugaugugcuuagcacucggcggaguacuuaucuuccucucaacagccguauccgccgacgucggcugcagcgucgacuucagcaaaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9480 - RNA, 2365 nt, Artificial Sequence
  KX447515.1 prME-long mRNA Design 3 opt
gggagaaagcuuaccaugcggaucaucaacgcacgcaaagagaagaaacgacggggagccgacaccucaguaggcaucgugggacuacuucucacaacggcaauggcagccgaaguaacacgcagaggaagcgccuacuacauguaccuagaccgcaacgacgccggcgaagcaaucagcuuccccacaacccuaggaaugaacaaaugcuacauacaaauaauggaccucggccacaugugcgacgccacaaugucauacgaaugccccaugcuagacgaaggaguagaacccgacgacgucgacugcuggugcaacacgacaagcaccuggguuguauacggaaccugccaccacaagaaaggcgaagcacgccgcucacggagagccguaacccuccccucacacagcacaagaaaacugcaaacacggucgcaaaccuggcuagaaucacgcgaauacaccaaacacuuaauccgagucgaaaacuggauauuccgcaauccaggcuucgcacucgccgcagccgccaucgcauggcuacugggaagcuccacaagccaaaaaguuaucuaccucguaaugauccuacuaaucgcccccgcuuacucgauacggugcauaggaguaucgaacagggacuucguagagggcauguccggcggcacaugggucgacgucgucuuagagcacgggggcugcguaaccgucauggcucaagacaaaccgaccguggacaucgaacucguaaccacaaccgugagcaacauggccgaaguaagaagcuauuguuacgaagcaagcaucucagacauggcaagcgacagcagaugcccaacccagggagaagcauaccuagacaaacaaucagauacacaauacgugugcaaaaggacacucguagacagaggaugggggaacggaugcgggcuuuucggaaaaggaucacucgucacaugcgcaaaauucgcaugcagcaagaaaaugacaggcaaaucaauccaacccgagaaccuggaauacagaauaaugcuauccguccacgggagccaacacuccggaaugauaguaaacgacacaggacacgaaacugacgagaaccgagccaaagucgagaucacaccaaacagcccacgcgcggaagccacacucggcggauucggaucccucggccucgacugcgagccacgaaccggccuagacuucucggaccuauacuaccuaaccaugaacaacaaacacuggcuggugcacaaagaaugguuccaugacauaccgcuuccauggcacgcaggagcagacaccggcacaccccacuggaacaacaaagaagcgcuuguugaguucaaagacgcccacgccaaaagacaaaccguaguaguacucggcagccaagaaggugccguacacacagcgcuugccggcgcccucgaagcagaaauggacggcgcaaaaggacgccuuagcagcggccaccuaaaauguaggcucaaaauggacaaacuaagacuaaaaggggucuccuauucccuaugcacggcagcauucaccuucacgaaaauccccgcagaaacccuccacggaaccguaacagucgaaguacaguacgcaggaaccgacggaccgugcaaagucccagcccagauggcaguggacaugcaaacccugacgccagucggccgacucaucaccgccaacccugugaucacggagagcacagaaaacagcaaaaugaugcucgaacucgacccacccuucggcgacucguacauagucauaggcguaggcgaaaagaaaauaacacaccacugguaccgcuccggcagcacaaucgggaaagcauucgaagccacagucagaggggcgaaacgcauggccguacuaggagacacagccugggacuucggcagcguaggaggcgcacuaaacagccuagggaaaggcauacaccaaaucuucggagccgccuucaaaagccuauucgguggaauguccugguucucccaaauacuaauaggcacacuccuaauguggcucggacuaaacaccaaaaacggaucaaucucccuaaugugucucgcccuaggcggaguacucauauuucuauccacagcagucagcgcagacguaggguguucagucgacuuuagcaaaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9481 - RNA, 2365 nt, Artificial Sequence
  KU501217.1 prME-long mRNA Design 3 opt
gggagaaagcuuaccaugcgaaucauaaacgcccggaaagaaaagaaacgccgcggagccgacaccuccgucggaauaguaggccugcugcucaccacggccauggcugccgaagugacccgccgaggaagugccuacuacauguaccucgacagaaacgacgcaggcgaagcaaucagcuuccccacaacguuaggcaugaacaaaugcuauauacagauaauggaccugggccauaugugugaugcaaccaugucauacgaaugccccaugcucgacgaaggagucgaaccagacgacguagauugcuggugcaacacaaccucgacauggguagucuauggaacaugccaccacaagaaaggcgaagcccgccgcucaagacgagcgguaacgcuaccuucgcauuccacacgaaaacuacaaacccgcucccaaacauggcuagaaagccgagaauacacaaaacaccucaucaggguagagaacuggaucuuccgcaacccaggcuucgcacucgccgcagcagccaucgccuggcuacuaggaagcagcacaucgcaaaaaguuaucuaccucguaaugauccuccuuaucgccccggccuacagcauacgcugcaucggggucuccaacagagacuucgucgaaggcaugagugggggcacguggguagacgucguacuagaacacggcggaugcgugaccgucauggcacaagacaaacccaccguggacauagagcuaguaacaaccacuguaucgaacauggccgagaucagaagcuacugcuacgaagccuccauauccgacauggccagcgacagcagaugcccgacacaaggagaagccuaccucgacaaacaaagcgacacacaauaugucugcaaacgcacccuagucgacagaggcuggggcaacgggugcggccucuucggcaaaggaagccucgucacaugcgcgaaauucgcaugcuccaaaaagaugaccggaaaaucgauacaacccgagaaccucgaauaccgaaucaugcuaaguguccacggcagccaacacucaggaaugaucgucaaugacaccggacacgagacagacgaaaaccgagccaaaguagaaauaaccccaaacucaccacgggcagaggcgacgcuaggcggauucggcucccugggccucgacugcgaaccacggaccggacucgacuucagcgaccuauacuaccucacgaugaacaacaaacacuggcuaguacacaaagaaugguuccacgacaucccacugccauggcacgcaggcgcagauacaggcacaccccacuggaacaacaaagaggcccuaguagaguucaaagacgcacacgccaaaagacaaaccguagugguacucggcagccaagaaggcgcaguacacacagcacucgccggcgcacuggaagcagaaauggacggagccaaaggccggcuauccagcggccaccugaaaugccgccucaaaauggacaagcucaggcucaagggaguaagcuacagccuaugcaccgcagcauuuaccuucacaaaaauccccgcggaaacucugcacggcaccgucacagucgagguucaauacgcaggcaccgacggcccaugcaagguccccgcacaaauggcuguggacaugcaaacacucaccccugucggcagacucauaaccgccaacccagucauaaccgagagcacagaaaauuccaaaaugaugcuagaacuagacccucccuucggggacagcuacaucgucaucggcguaggggagaaaaagaucacccaccacuggcaccggucaggcucaaccauaggcaaagccuucgaagcaacaguaagaggagccaaacgcauggccguacugggagauacagccugggauuucggaucugucggaggcgcacuuaacagccuuggcaaaggcauccaccaaaucuucggcgccgccuucaagucccucuucggcggaaugagcugguucagccaaauccuaaucggcacccuccuaauguggcucggacucaacaccaaaaacgguuccaucucauuaaugugccuagcccucggagguguccucauauuccuauccaccgcagucuccgccgacguaggcuguagcgucgacuucucuaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9482 - RNA, 2365 nt, Artificial Sequence
  KU312314.1 prME-long mRNA Design 3 opt
gggagaaagcuuaccaugcgcaucaucaacgcaagaaaagaaaagaaacgcaggggagcagacaccucggucggcauagucggacuccuacucaccaccgccauggcugcugaaguuacacgcagaggaucggccuacuacauguaccuggaccgcaacgacgcaggggaggccauaucguuccccaccacacuuggaaugaacaaaugcuacauacaaaucauggaccucgggcacaugugcgacgcaaccauguccuacgaaugccccaugcucgacgaaggaguagaaccagacgaugucgacugcuggugcaacaccacgagcacaugggucguuuacggcacaugccaccacaagaaaggugaagcccgccgcagucgacgagccgucacccuuccaagccacuccacacgaaaacuccaaaccaggagccaaaccuggcucgaaagccgagaauacaccaaacaccucauaagaguagagaacuggauauuccgcaacccaggcuucgcccucgcagccgccgccaucgcguggcuccuaggcaguagcaccagccaaaaagugauauaccuagucaugauacuacugaucgcaccagcauacucaauccggugcauaggaguaucuaaccgagacuucguagaaggcaugucaggagggacauggguggacguaguccucgaacacggagggugcguaacaguaauggcccaagacaaacccaccgucgacaucgagcuagucaccacgaccgucagcaacauggcagaaguccgguccuacugcuacgaagcaagcaucucggacauggccagugacucccgcugccccacgcagggcgaagcauaccucgacaaacaauccgacacccaauacgucuguaaacgcacacucguagaccgcggcuggggaaacggcugcgggcuauucggaaagggcagcuuagucacaugcgccaaguuugcaugcucaaagaaaaugaccggcaaaagcauacaacccgaaaaccucgaauaccguaucaugcuguccguacacggaucacaacacagcggaaugaucgucaacgacaccggccacgaaacagacgaaaacagagcaaaagucgaaauaacucccaauagcccacgcgcagaggccacacugggcgguuucggcagccugggccuagacugcgaaccccgcacaggccucgacuuuuccgaccucuacuaccucaccaugaacaacaaacacuggcucguccacaaagaaugguuccaugacaucccccucccauggcacgccggcgccgacaccggaaccccacacuggaacaacaaagaagcccuagucgaguucaaagacgcccacgcgaaacgacaaaccguaguaguacucggcagccaagaaggcgcaguucauacggcccucgcgggagcacucgaagcugaaauggacggcgcaaaaggacgacucucaucaggacaucugaaaugccgacucaaaauggacaaauuaagacucaaaggcguauccuacucgcucugcacggcagcauucacguuuacaaaaauaccagcagaaacccugcacggcaccguuaccguagaaguccaauacgccgguaccgacggcccgugcaagguccuagcacaaauggcagucgacaugcaaacauugacacccgucggccgacugaucacagcaaaccccgugaucaccgaaucaaccgaaaacuccaaaaugaugcucgaacuggacccaccauucggcgauagcuauaucgucaucggagucggcgaaaagaaaaucacccaccacuggcaccgauccggcuccacaaucggaaaagcauucgaagcaacaguacggggcgcaaaacggauggcaguccucggcgacacagccugggacuucggcagcgucggcggcgcccucaacagccuaggcaaaggcauccaccaaauauucggugcagccuucaagagccucuucggaggaaugagcugguucagccaaauacucaucggcacacuccuaauguggcugggccucaacaccaaaaacggcagcauaagccucaugugucuggcccuaggaggaguacuaauauuccuauccacugccgucagcgcagacguuggcugcagcguagacuucagcaaaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9483 - RNA, 2365 nt, Artificial Sequence
  KX446950.2 prME-long mRNA Design 3 opt
gggagaaagcuuaccaugcgcaucaucaacgcacgaaaggagaaaaaacgccgaggggccgauaccuccguuggcaucgugggacuccuccuaacuacagcuauggccgcggaagugacccgccgcggaagcgcuuacuacauguaccuagaucgcaacgacgccggcgaagccaucucauucccaacgacacugggcaugaacaaaugcuacauccaaaucauggaccuaggccacaugugcgacgccaccaugucuuacgaaugucccacacuugacgaaggcguagagcccgacgacguagacugcuggugcaacacgacgucaaccuggguuguauacggcacaugccaccacaaaaagggagaagccagacgcagcagaagagccgucacacuacccagccacucgaccagaaaacuacagacccgcagccaaacauggcuggaaucccgcgaauacacaaaacaccuaauacgcguagaaaacuggauauucaggaacccgggcuucgcccuagccgcagcagcaaucgccuggcuccuaggcuccuccacaucccaaaaagucauauaucucgucaugaucuuacucaucgccccagccuacucuauacgcugcaucggcgucuccaaccgcgacuucgucgaaggcauguccggaggaacauggguagacguaguacuggagcacgggggaugcgucacaguaauggcccaagacaaacccaccguagacauagaacuagucaccaccacagucucaaacauggccgaaguccgcucauacuguuacgaagcaagcauauccgacauggccuccgacucgcggugcccaacccaaggcgaggccuaccuagacaaacaaagcgacacccaauacgucugcaagcguacgcugguggaccguggauggggaaacggaugcggacuauucggcaaaggcagccucguuaccugcgcaaaauucgccugcuccaaaaaaaugacaggcaaaucgauucaacccgagaaccucgaauaccgaauaaugcuaagcguccacggaucacagcacuccggcaugaucgucaacgacaccggacacgagacagacgagaaccgcgcaaaaguggaaaucaccccgaacuccccccgugcagaggcaacccuaggcggcuucggcucacucggacucgacugugaacccagaaccggccucgacuucuccgacuuguacuaccucacaaugaacaacaaacacuggcuaguccacaaagaaugguuccacgacaucccccuccccuggcacgcaggagcggacaccggaaccccacacuggaacaacaaagaagcccucgucgaguucaaagaugcccacgcaaaacgccagacagucgucguccuaggaagccaagaaggagcaguacacacagcacucgcaggagcccuagaagccgaaauggacggugcaaaaggcagacucagcagcggacaucucaaaugcagacuuaaaauggacaaacuccggcucaaaggcgucagcuacagccucugcacagcagccuucacauucacaaaaauccccgcggaaacccuccacggcacuguaacggucgaaguccaauacgcaggaacggauggcccaugcaaagucccagcccaaauggcagucgacaugcaaacccucacccccgucggccgucucauaaccgcaaacccggucaucacagaaagcaccgaaaacagcaaaaugaugcuggaacuagacccacccuucggagauuccuacaucgucaucggcguaggcgaaaaaaaaauaacccaccacuggcacagaucagguucgacaaucggaaaagcguucgaagccaccguaagaggcgccaaacgcauggccguccucggagacaccgcaugggacuucggaucuguagguggagcccuuaacucccuaggcaaagguauccaccaaaucuuuggagcugcauucaaaucacuauucggcggaaugucaugguucagucaaauacucaucgggacccuacucauguggcuaggccuaaauaccaaaaacgggucgauaucacuaaugugccucgcacucggcggcguacucauauuucucucaaccgcgguaagcgcagacgugggaugcucagucgacuucagcaaaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9484 - RNA, 2365 nt, Artificial Sequence
  KY003157.1 prME-long mRNA Design 3 opt
gggagaaagcuuaccaugcgaauaauaaaugcacgaaaggaaaagaaacgaagaggagcagacacauccguaggaauagugggacuacuacuaaccacggccauggcagcagaaguaaccaggaggggaucggccuacuacauguaccucgacagaaacgacgcaggagaagcaaucuccuuccccacaacacucggaaugaacaaaugcuacauccagauaauggaucuuggacacaugugcgacgccacaaugagcuacgagugccccauguuagacgaaggcguugaaccagacgacgucgauugcuggugcaacacaaccucaacuuggguagucuacgggacaugccaucacaagaaaggggaggcccgcagguccagacgagccguaacacuccccagccauucaacacgcaaacuccagacgcgcagccagaccuggcucgaaagccgagaauacacaaaacaccuaauccgcguagaaaacuggauuuuuagaaaccccggauucgcacucgcagcagcggcuauagccuggcuccucggauccagcaccagccaaaaaguaaucuaccucguaaugauccugcucaucgccccagcauacagcauccgaugcaucggagugagcaacagagacuucguagaaggcaugucaggcggcaccuggguagauguaguacucgaacacggaggaugcguaacgguaauggcccaagacaaaccaacaguggacaucgaacucgugaccaccaccgucuccaacauggcagaaguacggucauacugcuacgaagccucaaucagcgacauggcaagcgacuccagguguccgacccaaggcgaagcauaccucgacaaacaaagcgacacccaauacgucugcaaacggacccuaguagaccgaggcugggguaacggcugcggccucuuuggaaaaggaagccucguaacaugcgccaaauuugccugcagcaaaaagaugacagggaaaagcauacaaccagaaaaccuagaauacagaauaaugcucuccguccacggcagccaacacucaggcaugauaguaaacgacaccggacacgaaacggacgagaacagagccaaagucgaaauaaccccaaacagcccacgcgccgaagccacgcucgggggcuucggaucauugggauuagacugugaaccccgcacaggucucgauuucagcgaccucuauuaccucaccaugaacaacaagcacuggcugguacacaaagaaugguuccacgacauaccacuccccuggcacgccggugcagacaccggcacaccccacuggaauaauaaagaagcguuggucgaguucaaagaugcccacgcgaagagacaaaccguaguagugcucggcagccaagaaggagccguacacaccgcccucgccggcgcucucgaagccgaaauggacggagccaaaggucgccugagcuccggccaccuaaaaugccgacuaaaaauggacaaacuuagacuaaaaggaguaucauacucacucugcacggcagccuuuaccuucaccaaaaucccggcagaaaccuuacacggaacaguaacagucgaagugcaauacgcaggcacagacggccccugcaaaguccccgcacagauggccguagacaugcagacccucaccccggucggacgccucaucacagcuaacccggugaucaccgaauccaccgaaaacagcaaaaugaugcucgaacuugacccacccuucggcgacagcuacaucgucaucggagugggagaaaagaaaaucacgcaucacuggcaccguagcggaucaacgauaggaaaggccuucgaggccacgguaagaggcgcgaaaagaauggcaguccuaggagacacagccugggauuucgggucggucgguggcgcacucaacucacuaggcaaaggcauccaucaaaucuucggcgccgccuucaaaagccuauucggaggaaugagcugguuuagccaaauacuuauaggcacacuccuaauguggcucggacucaauacaaagaacggaagcaucucacuaaugugucuagcccuaggcgggguccucauauuccuauccacagucgucagcgccgacgucggcugcagcguugacuucagcaaaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9485 - RNA, 2365 nt, Artificial Sequence
  KX811222.1 prME-long mRNA Design 3 opt
gggagaaagcuuaccaugagaaucaucaaugccagaaaagaaaagaaacggcgcggagccgacacauccgucgggauaguaggacuccugcucacaaccgcaauggcagcggaggucacucgacggggcucagcguacuacauguaccucgacagaaacgacgcaggagaagcaauaucauuccccacaacacuaggaaugaacaaaugcuauauccagauaauggaccuaggccacaugugcgacgcgacaaugagcuacgaguguccaaugcucgacgaaggaguagaacccgacgacguagacugcuggugcaacaccaccuccgcauggguaguguacggaacaugccaccacaagaaaggcgaagccagacgcucgcgcagagccgucacccuacccagccacuccacccgaaaacuucaaacccgcccacaaacauggcuagaaucacgggaauacaccaaacaccuaauacgcguugaaaauuggauauucagaaaccccggauucgcacuagcugccgcugccauagccuggcuacuagggaguucaacaucacaaaaagucaucuaccuagucaugaucuuacucaucgcacccgccuacagcauccgcuguauaggagucagcaaucgagacuuuguagagggaaugagcgggggcaccuggguagacgucguccuagaacacggcggaugcguaaccgucauggcgcaagacaaaccaaccgucgacaucgaacucgucacaacaaccgucucaaacauggccgaaguucgaucauacugcuacgaagcgaguauaucagacauggccagcgacucccggugccccacccaaggugaagcauaccuggacaaacaaagcgacacccaguacgucugcaaaaggacccugguggaccgcggauggggcaacggcugcggacucuucggcaaaggcagccucguuacgugcgcuaaauucgccugcagcaagaaaaugacaggcaaauccauccaacccgaaaaccuagaauaccgaaucaugcuaagcguacacggcucgcaacacucaggcaugauagucaacgacaccgggcacgaaaccgacgaaaaccgagccaaaguagaaaucacgccaaacucaccccgagccgaggccacacucggcggcuucggaucccucggccuagacugcgaacccagaacaggucucgacuucuccgaccuauacuaccugacaaugaauaauaaacacuggcucguccacaaagagugguuccacgauaucccacugcccuggcaugccggcgcggacaccggcacaccccacuggaacaacaaagaagcccuaguagaguucaaagacgcacacgccaaaaggcaaaccgucgucguccuaggaucccaagaaggcgccguccacaccgcccucgccggcgcccuagaagcagaaauggacggagccaaaggccgccucucaucaggccaccucaagugccgccuaaaaauggacaagcuacgacuaaaaggcgugagcuacucccucugcacagcggccuucaccuucacgaagauaccagccgaaacacuccacgggaccgucaccguagagguacaauacgcaggaacagacgggcccugcaaaguacccgcccaaauggccguagacaugcaaacccucaccccaguaggacgacucauaaccgccaacccagucauaaccgagagcaccgaaaacagcaaaaugaugcuagaacuagacccacccuucggcgauaguuacauuguaauaggcguaggcgaaaagaaaaucacacaccauuggcacagauccggaucaaccauuggcaaagcauucgaagcaaccguacgcggcgcuaaacgcauggccguacucggcgauaccgcaugggacuuuggauccgucgggggagcauuaaacucacuaggaaaaggcauccaccagauauucggcgccgcauucaaaucacucuucggaggaaugucaugguuuagccaaauacucauaggcacacuccucauguggcuaggccucaacaccaaaaacggaagcauaucccuuaugugccucgcccucggcgguguucucaucuuucuauccacagccgucagcgccgacgucggcugcucagucgacuucucaaaaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9486 - RNA, 2365 nt, Artificial Sequence
  KX447516.1 prME-long mRNA Design 3 opt
gggagaaagcuuaccaugcgcaucaucaacgcccgcaaagaaaagaaacgacgcggcgcugacaccuccguaggcauaguaggacuccuacucaccaccgcaauggcagcagaagucacccgccgaggcagcgcauacuacauguaccucgacagaaacgacgccggugaagccauaucauuccccaccacccucggaaugaacaagugcuacauccaaauaauggaccuuggccacaugugcgacgccaccaugagcuacgaaugcccaaugcucgacgaaggaguagagccagacgacgucgacugcuggugcaacacgaccuccacuugggucgucuauggcacgugccaccacaagaaaggagaagccagaagaucacgccgugcaguaacgcuaccgagccacucaacccgaaaacuucaaacccguagccagaccuggcuagagucacgcgaauacacuaaacaccugauccgcguagaaaacuggauauuucgcaaccccggcuucgcgcucgcagccgcggcaauagccuggcugcuaggaucguccaccuccaaaaagguuauauaccucguaaugauccuccucauagcucccgcauacucaauaaggugcauaggcgucagcaaccgcgacuucgucgaaggcauguccggaggcaccuggguagacgugguccucgaacacggaggaugcgucacagugauggcacaagacaaacccaccgucgacauagaacucgucaccacuacagucagcaacauggccgaagucagaucauacugcuacgaagcaagcaucagcgacauggcauccgacucgcgcugccccacccaaggcgaagcauaccuagacaaacaaagcgacacccaguacguaugcaaacgcacacucgucgaccggggcugggggaacggcugcggucucuucggaaaaggcucccucguaaccugcgccaaauucgcaugcuccaagaaaaugaccggcaaaagcauccaacccgaaaaccucgaauaccgaaucaugcuaucgguccacgguucccaacacagcggaaugauagucaacgacaccggacacgaaaccgacgaaaaccgagccaaagucgaaauaacacccaacagcccgcgagcagaagccacacuaggcggauucggaagccucggccuagacugcgagccccgcacaggauuagacuuuuccgacuuauacuaccuaacgaugaacaacaaacacuggcucguccacaaagaaugguuccacgacauaccacuaccauggcacgcaggggccgacaccggaacaccacacuggaacaauaaagaggcacucguagaauuuaaagacgcacacgcaaaacgacagaccguugucguacucggaucccaggagggagccguccacaccgcacuagccggugcccuagaagcagaaauggacggagcaaaaggaagacuaaguagugggcaccucaaaugccgucuaaaaauggacaagcucaggcuaaaaggcgugagcuacucccucuguacagccgccuucaccuucaccaaaauccccgcugaaacacuacacggaaccgucaccgucgaaguccaauacgccggcaccgacggccccugcaaaguucccgcccagauggccgucgacaugcaaacccucacacccgucggucgacucaucacagcgaaccccgugauaaccgaaagcacugaaaauagcaaaaugaugcucgagcuggacccacccuuuggggacagcuacauaguaaucggcgucggcgaaaagaaaaucacccaccacuggcacagaagcgggagcaccauaggaaaagcauucgaagcaacaguccgcggugcaaaacguauggccguacucggagacacagccugggacuucggcagcguaggcggugcacuaaacagccuaggaaaaggaauacaccaaauauucggagccgccuucaaaagccucuucggaggcaugucgugguucucgcagauucucauaggcacacuucuaauguggcuaggccuaaacaccaagaacggcucaaucagccuaaugugccuggcacucggaggcguccuaaucuuccuaucaacagcagucagcgcagacgucggaugcagcguagacuuuuccaaaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9487 - RNA, 2365 nt, Artificial Sequence
  KX520666.1 prME-long mRNA Design 3 opt
gggagaaagcuuaccaugagaaucaucaacgcacgaaaagaaaagaaacgacgcggagccgacacauccguaggcaucguuggacuacuauuaaccacagcaauggccgccgaaguaacaagaagagguagcgcauacuacauguaucuugaccggaacgacgccggcgaagccaucagcuucccgaccacacuagggaugaacaaaugcuacauucaaauaauggaccugggccauaugugcgacgcaacaaugucauacgaaugcccgaugcucgacgagggcguagaaccggacgacgucgauugcuggugcaacacaacuucaacuugggucgucuacgguaccugccaccacaagaaaggcgaagcccgccgcucgcggcgcgcaguaacgcuacccagccacuccacgcgcaaacuacaaacccgcucccagaccuggcuagaaucgcgagaguacacaaaacaccuaauccgcguggaaaacuggauuuuccgaaacccaggcuucgcccucgcagccgcagcgaucgcauggcuccuaggcaguagcacacgacaaaaaguaauauaucuuguaaugauacuucucaucgcccccgccuacagcauccgaugcauuggcgucagcaacagggacuucguagaaggcauguccggaggaaccuggguagacgucguucucgaacacggcggcugcgucaccguaauggcacaagauaaaccgaccguagacaucgaacuugugaccaccacgguguccaacauggccgaaguaagaagcuacugcuaugaagcaagcaucagcgacauggccagcgacagcagaugccccacacaaggcgaggcuuaccucgauaaacaaucagacacccaguacguaugcaagcgaacccuagucgacagaggcuggggaaacggcugcggccucuucgguaaagggucacucguuaccugcgccaaauucgccugcagcaagaaaaugaccggcaagagcauccaacccgaaaaccucgaauaccgaaucaugcugucaguccacgguagccaacacucagguaugauagucaacgacaccggacacgaaacagacgaaaacagagcaaaagucgaaaucacacccaacagcccuagagcggaagccacccucggaggcuucggcagccuaggccuagacugugaaccacgcacaggccucgacuucagcgacuuauauuaucucacaaugaacaacaagcacuggcuaguccacaaagaaugguuccacgacauaccacuacccuggcacgcaggagcagacaccggcacaccccacuggaacaacaaagaggcacucguugaauuuaaagacgcacacgccaaacgacaaaccgucguaguacuaggaagccaagaaggcgcaguacacacagcccuagccggggcgcuagaagccgaaauggacggcgccaagggacgccucuccuccggacaccucaaaugucggcuaaaaauggacaaacuaagacuaaaagggguauccuacagccucugcacggcagccuucaccuuuaccaaaaucccagccgaaacccuacacgggacagucacaguagaaguucaauacgccgggaccgacggaccaugcaagguccccgcgcaaauggccguggacaugcaaacccuaacaccuguaggccgacucauaaccgccaaccccguaauaaccgaaagcaccgaaaacuccaaaaugaugcucgaauuagaucccccauucggcgacagcuacauaguaauaggcguaggcgagaaaaagaucacgcaccacuggcacagauccggcagcaccaucggaaaagccuucgaggcaaccgugcgaggcgccaaacgcauggccguccucggagacacggcaugggacuucggaucaguaggcggagcccuaaacagccuaggaaaaggaauacaccaaauauucggcgcagccuucaaauccuuauucggcggcaugagcugguucucacaaauacuaaucgggacccugcucauguggcucggacucaacaccaaaaacggaagcauaucccucaugugccucgcacucgggggcguacuaaucuuccugagcacagcaguauccgccgacguagguugcucggucgacuucuccaaaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9488 - RNA, 2365 nt, Artificial Sequence
  KU729218.1 prME-long mRNA Design 3 opt
gggagaaagcuuaccaugcgcauaaucaacgcgcgaaaagaaaagaagcgaagaucggcagacaccagcgucggcauagucggccuacuccucaccaccgcgauggccgcagaagucacacgcaggggcuccgcauacuacauguaccucgaccgaaacgacgccggcgaagccaucaguuuccccacaacacuaggaaugaacaaaugcuacauacaaaucauggaccuggggcacaugugcgacgccacaauguccuacgaaugccccaugcuggacgaaggcguggaaccggacgacguagacuguuggugcaauaccaccagcaccuggguaguguauggcacaugccaccacaagaaaggagaagccagacgcucacggcgcgcagugacacucccaagccacagcacucguaaacuacaaacccgaagccaaaccuggcuagaaucccgagaauauacaaaacaccucauaagaguagaaaacuggauauuccgaaaccccggauucgcgcucgcagccgcagcaauagcauggcuacuuggcucaagcaccagccaaaaagucauauaccuagucaugauacugcucaucgccccagcauacucaaucagaugcauaggcguaagcaaccgagacuucguugaagggaugucuggagggacaugggucgacgucguacuagaacacggaggcugcgucacggucauggcccaggacaaaccaacgguagauauagagcucguaacgacaaccguaagcaacauggcagaaguacgcaguuacugcuacgaagccagcauaucagauauggccuccgacucccgcugccccacacagggagaggccuaccucgacaaacaaucagacacacaauacgucugcaaacggacgcuaguagaccgcggcuggggaaauggaugcggucucuucggcaaaggaucgcuagugacaugugccaaauucgcaugcuccaagaaaaugacaggcaaauccauccaaccagaaaaccuagaguacagaauaaugcucagcguacacggcagccaacacagcggcaugauagucaaugacacaggacacgaaaccgacgaaaaccgggccaagguagagauaacccccaacagcccaagagcagaggcgacccugggcgguuucggcagccucggccuagacugcgagccaagaacaggacucgacuucagcgaccucuacuaccuaacaaugaacaacaaacacuggcuaguacacaaagaaugguuccacgacauaccacuaccauggcacgccggcgcagacaccgggacaccacacuggaacaacaaggaagcccuagucgaguucaaggacgcacacgcaaaacgacagaccgucguaguacuaggaucacaagaaggggccguacacacagcccuagccggugcacuagaagcagaaauggacggagcaaaaggacgccuaucaagcggccaccuaaaaugccgccucaaaauggauaaacuucgucuaaaaggagucagcuacagcuuaugcacugcagcauucacauucacaaaaaucccagcagaaacacuacacggaaccgucacaguggaaguccaauacgccggaacagacggcccaugcaaaguaccagcccaaauggcggucgauacccagacacucaccccagucgggcgacucauaacagcaaacccagucaucaccgaaucgacagaaaacucaaaaaugaugcuagaacucgacccacccuucggcgacagcuauaucguaauagggguaggagagaaaaagauaacacaccacuggcaccggagcggcagcaccauaggcaaagcguucgaagccacaguccguggagcaaaaagaauggcaguauugggggauacggccugggacuucggcagcguaggaggagcccucaacagccuaggaaaagggauccaccaaauauucggcgccgcguucaaaagccuguucggaggaaugagcugguucucccaaauacuaaucgggacccuccucauguggcucggacuuaacaccaaaaacggaagcaucucacuaaugugccuagcacuaggaggagugcuaauuuuccugaguacagccguauccgcggacgucggcugcuccguugacuucuccaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9489 - RNA, 2365 nt, Artificial Sequence
  KU761561.1 prME-long mRNA Design 3 opt
gggagaaagcuuaccaugagaaucaucaacgcaagaaaagaaaagaaaagacgaggagccgacacaaacguaggaaucgucggacuacuccucacaacugcaauggcagcagaagucacgcgacgaggauccgccuacuacauguaccuagaccgcaacgacgcgggcgaagcaauaucauucccaaccacccuggggaugaacaaaugcuacauacagauaauggaccucggacacaugugcgacgcgaccaugagcuacgagugcccaaugcucgacgaaggcguggaaccagacgaugucgacugcuggugcaacaccacgagcacaugggucguauacgggacaugccaccacaagaaaggagaagcgaggcgaucccggagagccgucacccucccgagccacucaacacgaaaacuacaaacaagaucgcaaaccuggcuagaaucgagagaauauaccaaacaccuaauaaggguagaaaacuggaucuuccgcaacccgggcuucgcgcuagccgcagccgcaauagccuggcugcuagggagcucaacaagccagaaaguaaucuaucuaguaaugauccuccuaauagccccagcauacagcauccgcugcauaggcguaagcaacagggauuucguagaaggaaugagcggaggcacauggguagacguagugcucgagcauggaggaugcgucacagucauggcacaagacaaaccaacagucgacauagaacugguaacaaccacaguguccaacauggcagaaguccgcagcuacugcuacgaagccagcauaagcgacauggcaagcgacagccggugcccaacacaaggagaagccuaccuagacaaacaauccgacacacaauacguuugcaaacgcacguuaguagaccgcggauggggaaacgguugcggacucuucggcaaagguagcuuggugacaugcgccaaauucgccugcaguaagaaaaugacaggcaaaagcauccaaccagagaaccuagaguacagaaucaugcucagcguccacggcucccaacacaguggaaugaucguaaacgacacaggacacgagacggacgaaaacagagcaaaaguagaaaucacacccaacagcccacgggcagaagccaccuugggaggauucggaucccuaggucucgacugcgaacccagaaccggauuagauuucuccgaccucuacuaccuaaccaugaacaacaaacacuggcucguccacaaagaaugguuccacgacaucccauuaccauggcacgccggugccgacacaggaaccccgcacuggaacaacaaagaagcccuaguggaguucaaagacgcccacgcaaaaagacaaacaguagugguucuaggaucccaagaaggugcaguccacacugcacuggcgggugcacucgaagccgagauggacggcgcaaaaggccggcuaucgagcggccaccuaaaaugcaggcucaagauggacaagcuaagacucaaaggcgugagcuacucacucugcaccgcagcguucacauucaccaaaaucccagccgaaacccuacacgggacagucacaguggagguccaguaugcaggcaccgauggcccaugcaaaguaccggcccaaauggcaguagacaugcagacacuaacaccggucggccgacuaauaacagcaaacccaguaaucacagaaagcaccgagaacucgaaaaugaugcuagaacucgaucccccauucggcgacagcuacaucguaaucgggguaggggagaagaaaaucacccaccauuggcaccggagcggcagcacgaucgggaaagcauucgaagccacgguacgaggagcgagacgaauggcaguccucggggacaccgcaugggacuucggcaguguuggcggagcauugaacucgcucgggaaagggauacaccagauuuucggggcagcauucaaaucacuauucggagggaugagcugguucagccagauccucaucggaacccuacugauguggcuuggacuaaacaccaaaaacggauccauaagccuaaugugccuagcccugggaggaguccuaauauuccuaaguacagccguaagugccgacguaggaugcagcgucgacuucucaaaaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9490 - RNA, 2365 nt, Artificial Sequence
  KY317938.1 prME-long mRNA Design 3 opt
gggagaaagcuuaccaugcgaaucauaaacgcccgaaaagaaaagaaacgacgcggagcagaaaccucgguaggcauaguaggacugcuacuaaccacagcgauggcagccgaaguaacaagaagagguucagccuacuacauguaccucgaccgcaacgacgcaggcgaagcgaucagcuucccaacgacgcuaggaaugaacaaaugcuacauacaaauaauggaccugggccauaugugcgacgccacgaugaguuacgaaugccccauguuggacgagggagucgagccagacgacgucgacugcugguguaacacaacgagcacgugggucgucuacggaaccugccaccacaagaaaggcgaagcccgacgaucaagacgcgcaguaacacuaccgagccacuccacacgcaaacuccaaacaagaagccaaaccuggcucgaaagccgagaauacacaaaacaccuaauccgcguagaaaacuggaucuuccgcaacccaggcuucgcacuagcagccgccgcaauagcauggcuccucgguagcagcaccagccaaaaagucaucuaucuaguaaugauacuccuuauagcgccagcauacuccauucgaugcaucggcguuaguaaccgcgacuucguagaaggaaugucggguggaaccuggguagacgugguacucgagcacgguggcugcguaacggugauggcgcaagacaaacccacagucgacaucgaacucgugacaacaacaguaagcaacauggccgaaguccggucauacugcuacgaggcaucaaucagcgauauggccucagacagccgcugccccacgcagggcgaagccuaccucgacaaacaguccgacacacaauacgucugcaaacgaacgcuagucgacaggggaugggggaacggcugcggacucuucggcaaaggaucccuaguaaccugcgcaaaauucgccugcucaaagaaaaugacaggaaaaagcauucaaccagaaaaucuagaauacagaaucaugcugucaguucacggcucacaacacagcggcaugauaguaaacgacacaggccacgaaacagacgagaaccgagccaaaguagaaaucacucccaauagcccaagagcagaagcaacccuuggaggguucgggucacuuggacuagacugcgaaccacgaaccggccuagacuucagcgaccuuuacuaccucaccaugaacaauaaacacuggcucguacauaaagaaugguuccacgacaucccacugccguggcacgcaggcgccgacacagguacaccacacuggaacaacaaagaagcacugguagaguucaaagacgcccaugcgaaacgccagaccgucguugugcugggcucacaagaaggagccguacacacagcacuggccggagccuuagaagccgaaauggacggcgcgaaaggacgcuuguccuccggccaccucaaaugccggcuaaaaauggacaaacuacgccugaaaggaguuucguauucacugugcacagcagcguucaccuucaccaaaauaccagccgaaacccuacacggcacaguaaccgucgaaguacaauacgcgggaaccgacgggcccugcaaaguuccagcacaaauggcgguagacaugcaaaccuuaacaccgguaggcagacuaaucacagccaacccagucaucaccgaaaguacggaaaauucgaaaaugaugcuagaacuagacccgccauucggagacagcuacauaguaaucggggucggcgaaaagaaaauaacacaccacuggcacagaagcggcagcacgauaggcaaagccuucgaagccaccgucagaggcgcgaaacggauggcaguacuaggcgacaccgccugggacuucggcagcgucggcggagcccucaacagcuuaggcaagggaauccaccaaaucuucggcgccgcauucaagagccucuucggcggcaugucgugguucucccaaauccucauaggcacucuacuaauguggcuaggacucaacacgaaaaacggcagcauaagccugaugugccucgcguuaggcggaguccucauauuccugagcacagccgucucagcggacgucgggugcagcguggacuucagcaaaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9491 - RNA, 2365 nt, Artificial Sequence
  KY075939.1 prME-long mRNA Design 3 opt
gggagaaagcuuaccaugagaauaaucaacgcccgcaaagagaaaaagcgcagaggcgcagacacauccguaggcauaguaggccuacuccugacaacagcaauggccgccgaaguaacccgucgaggaucagccuacuacauguaucuagaccgaaacgacgccggagaagcuaucagcuuccccaccacacucggcaugaauaaguguuacauccaaaucauggaccucggccacaugugcgacgcaaccaugagcuacgaaugcccaaugcuggacgaaggcguagaacccgacgacgucgacugcuggugcaacaccaccuccaccugggucgucuacggaaccugccaccauaagaaaggggaagccagacggagccgacgugcgguaacgcuccccagccacucaacucgcaaacuccaaacccgcagccaaacguggcucgaaagccgggaauacaccaaacaccuaaucagaguggaaaacuggauauuccgaaaccccggauucgcgcucgcagcagccgcgauagcuuggcugcucggaagcuccaccucccagaaaguaauauaucuagucaugauccuccucauagcacccgccuacagccuccgcugcauaggcguauccaaccgagacuucguggaaggcaugagcggcggcaccuggguagaugucguacucgaacacggaggcugcgucaccguaauggcccaagacaaacccacaguagacauagaacuugucacaaccaccguauccaacauggccgaagugcgguccuacugcuacgaagccagcauaucagacauggccucggacucacgaugcccaacccaaggcgaagccuaccucgacaaacaaagcgacacccaauacguaugcaaacgcacacucguagacagaggauggggcaacgggugcggucuuuucggaaaaggaucacucgucacaugcgcaaaauucgccugcuccaaaaagaugaccggaaaaucaauccaaccagaaaaccuagaauaccgcaucaugcucagcguacauggcucccaacacuccggcaugauagucaacgacaccggacacgaaaccgacgaaaaccgcgcaaaaguagaaaucacacccaacagcccacgagccgaagccacccugggaggguucgggagccuaggacucgacugcgaaccgcgaacgggacuagacuucuccgaccucuacuaccuuaccaugaacaacaaacacuggcucguccacaaagaaugguuccacgacaucccauuaccauggcacgccggcgcugauaccggcaccccacacuggaacaacaaagaagcccucgucgaguucaaagacgcucacgcgaaacgccaaaccguagucguacucggcucacaagaaggcgccgugcauaccgcacuagcaggggcacuagaagcagaaauggacggcgcaaaaggccgccucagcucuggccaccuuaaaugcagacuaaaaauggacaagcuacgccuaaagggcgugagcuacucacugugcaccgcagccuuuaccuucaccaaaauccccgccgaaacucuccauggaaccguaacagucgaaguccaguacgccggcacggacggaccaugcaaaguccccgcacaaauggccguugauaugcaaacacugacacccgugggaagacucaucaccgccaacccagucaucaccgaaagcacagaaaacucaaaaaugaugcuggaauuagacccaccauucggcgacucauacaucgugaucggggucggagaaaagaaaauaacacaccacuggcaccgcagcggaucaacaauaggcaaagcauucgaagccacagucagaggggcaaaaagaauggcgguacuaggagacacagcaugggacuucggcucagugggcggagcccucaacucccuuggaaaaggcauucaccaaaucuucggggcagcauucaaaucccuauucggaggaauguccugguucucgcaaauacucaucggcacgcuccuaauguggcuaggacuaaacaccaaaaacggaaguauaucccuaaugugccucgcgcucggaggcguacuaauuuuccugagcaccgcagucagcgcagauguaggcugcuccgucgacuucagcaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9492 - RNA, 2365 nt, Artificial Sequence
  KX806557.2 prME-long mRNA Design 3 opt
gggagaaagcuuaccaugcgcauaaucaaugcacgaaaggagaaaaagcgcaggggagccgacaccaacguaggcauagucggccuacuucuaacaacagcaauggcggccgaaguaacaagacgcggaucagccuacuacauguaccucgaccgaaacgacgccggcgaagccaucagcuuccccaccacccucggcaugaacaaaugcuacauacagauaauggaccucggucacaugugcgacgccacaaugucauacgaaugccccaugcuagacgagggaguggaaccggacgacgucgacugcuggugcaacaccaccagcaccuggguagucuacggaaccugccaucacaagaaaggcgaagccagaagaucccgacgcgcuguaacccuccccagccacagcacucgcaaacuccaaaccaggucacaaaccuggcuagaaucucgagaguacacaaaacacuuaauacgaguagaaaauuggauguuccgaaaccccggauucgcccucgcggcagcagcaauagccuggcuccucggauccuccacaucgcaaaaagucauauaccuuguuaugauccuacuaaucgcaccggcauacagcauccgcugcaucggagucucaaacagagacuucgucgaaggaaugucgggcggcacaugggucgacgucguucuugagcacggaggaugcgucacggucauggcucaagacaaaccuacaguagacauagagcugguuacaacaaccguguccaacauggccgagguccgguccuacugcuacgaggcauccaucagcgacauggccuccgacucacgaugcccaacccaaggggaggcuuaccucgacaaacaaagcgacacacaauacgucugcaaacgaacacugguugauaggggauggggcaacggcugcggccuuuuuggcaaaggaagccuggucacaugcgccaaguucgccugcagcaagaaaaugacgggcaaaaguauacaaccagaaaaccuggaauaccgaaucaugcucagcguccacgguucccaacacuccggcaugauaguaaacgacacaggccacgaaacagacgaaaacagagcaaaagucgaaaucacccccaacagcccacgggccgaagccacacugggcgguuucggcagccucggacucgacugcgaaccgcgcacgggacucgacuucucagaccucuacuacuuaacaaugaacaacaaacacuggcucguccacaaagaaugguuccacgacauuccccuaccauggcaugccggagcggacaccggcacaccccacuggaacaacaaagaagcacuggucgaguucaaagacgcacacgccaaacggcaaacagucgucguccuaggaucacaagaaggagcaguccacacggcacuagcgggcgcccuagaagccgaaauggauggcgcaaaaggccggcuaucaagcggacaccuaaaaugcagacuaaaaauggacaaacuuagacucaaaggcguaagcuacagcuuaugcacagccgccuucaccuucacgaaaauccccgcagaaacacuccaugguacagucacgguagaagugcaauacgccggcacagacgggccaugcaaagucccugcacaaauggcagucgacaugcagacccuaaccccagucggccgacucauaacggccaauccagucaucacagagucaaccgagaacagcaaaaugaugcucgagcucgacccgccauucggcgacagcuauaucgucaucggugucggcgaaaagaaaaucacacaccauuggcacaggagcgguagcacaauaggcaaggcauucgaagcaaccguccgcggcgccaaacgcauggccguccuaggagacaccgccugggacuucggaucaguagggggcgcccucaauagccugggcaaaggcauccaucaaaucuucggggcagccuucaaaagccuuuucgguggaauguccugguucagccaaauccucauaggcacccuccuaauguggcucggccucaacacgaaaaacggguccauaucccucaugugucuagcacuaggcggaguccucaucuuccucuccaccgcggucucggccgacgucggaugcucgguagauuucucaaaaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9493 - RNA, 2365 nt, Artificial Sequence
  KU870645.1 prME-long mRNA Design 3 opt
gggagaaagcuuaccaugagaauaaucaacgcccgaaaagagaaaaagcgccgaggcgccgacacaagcgucggcaucgucggacuucuccuaacaacagccauggccgcggaaguaacaagaaggggcagugcauacuacauguaccucgaccgcaacgacgcaggagaagccaucagcuuccccacaacauuaggcaugaauaaaugcuacauacagaucauggacuugggccacaugugcgacgccacaaugagcuacgaaugccccaugcucgacgaaggcguagaaccagacgacgucgacugcuggugcaacacaacaagcacgugggugguauacggaaccugccaccacaagaaaggagaagcaagacgaagccguagagcagugacacuccccagccacucgaccagaaaacugcaaacacgcagccaaaccuggcucgaaucacgagaauacaccaaacaccucauccgagucgaaaacuggauacuacggaaccccggauuugcacucgcagcagccgccaucgcauggcuacucggcucaucgaccucccagaaagucauauaccuuguaaugauacuccuaaucgcgcccgccuacagcauccgaugcaucggcgugucuaaucgagacuucguagaaggcaugagcggaggcacaugggucgacgucguacuggagcacggaggcugcgugacgguaauggcacaggacaaacccacagucgacauagagcuagucacaacgaccgucuccaacauggcagaaguacgcagcuacuguuacgaagccagcauaagcgacauggccagugacagccggugcccaacccaaggggaagccuaccuagacaaacaaagcgacacacaauacguaugcaaaagaacccucgucgaucgaggcuggggaaacggaugcggccucuucgggaaaggaucccucgugaccugcgccaaauucgcaugcagcaagaaaaugaccggaaaaaguauacaaccagaaaaccuagaguaucgcauaaugcuaucaguccacggcucccaacacuccgggaugauagucaacgacaccggccacgaaacagacgaaaaucgcgcaaaagucgaaaucaccccaaacagcccaagagcugaagccacccuaggaggauucggaucccucggccucgacugcgaaccacgaacaggccucgacuuuuccgacuuauauuaccucacaaugaacaacaaacacuggcuaguccacaaggaaugguuccacgacaucccacuacccuggcacgcaggcgcagacacaggcaccccacauuggaacaacaaagaagcacucguggaguucaaagacgcucacgcaaaacgccaaacaguaguaguccuaggcucacaagaaggugccguccacacagcucucgccggagcccuagaagcagaaauggauggagcaaaaggccgccugucgagcggccaccucaaaugucgacuaaaaauggacaaacuacgccuaaaaggcgucagcuacagcuuaugcacagcagccuucaccuucacaaaaauaccggcggaaacacuccacggcacggucacgguugaaguccaauacgccggcacagacggucccugcaaagucccagcacaaauggcagucgacaugcaaacccuaaccccaguagggcgucuuaucacagccaacccagucauuaccgagucaacagaaaacaguaaaaugaugcuagaacucgacccacccuuuggggacucguacaucgucaucggaauaggagaaaagaaaauaacccaccacuggcaccgaagcggcuccaccauaggcaaagccuucgaagcaacaguaagaggagcaaaacgcauggcaguacuuggagacaccgcgugggacuucggaagcgucggaggcgcgcucaacagccucggcaaaggcauccaccagaucuucggcgccgcguucaaaagccuguucggaggaaugucaugguucucccagauacuaaucggaacccuccuaauguggcuagggcugaacacgaaaaacggaucgauaagccuaaugugucucgcccuaggaggcguacuaauauuccucuccacagcaguaagcgcagacgucggcugcuccguagacuucucaaaaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9494 - RNA, 2365 nt, Artificial Sequence
  KU729217.2 prME-long mRNA Design 3 opt
gggagaaagcuuaccaugaggauaauaaacgcacgaaaagagaaaaagcgaagaggagccgacacauccgucggaaucgucggacugcuauuaacaacagccauggccgcagaagucacccgcagaggcuccgccuacuacauguaccuagaccgaaacgacgcgggugaagcaaucuccuuccccaccacacucgguaugaacaaaugcuacauacagaucauggaccucggccacaugugcgacgcaacgauguccuacgaaugcccaaugcuagacgaaggcguagaacccgacgacgucgacugcuggugcaacacaaccaguacaugggucguauacgggaccugccaccacaagaaaggagaagcccgaagaucccggcgggcaguaacccuaccgucacacuccacacgcaaacuucaaacgcgaagccaaaccuggcuagagaguagggaauauacaaaacaccuaauaagaguagagaacuggauauuccgcaaccccggauucgcgcucgcggccgccgcaauagcauggcuacucggcagcagcaccagccagaaaguaauauaccuagucaugauccuacucauagccccggcuuacucaauccgcugcauaggggucagcaaccgcgacuucguagaaggcaugagcggaggaacauggguggauguaguacuagagcacggcgggugcguaaccguaauggcacaagacaaaccuaccgucgacaucgaacucguaagcacaacuguauccaacauggccgaaguaaggucuuacugcuacgaagccaccauauccgacaucgccuccgacuccagaugcccaacgcaaggggaagccuaccuagacaaacaauccgacacacaauauguaugcaaacgaacccuagucgacagaggauggggaaacggcugcggacuauucggcaaaggaagucugguaaccugcgcaaaauucgcaugcuccaagaaaaugacaggaaaauccauacaacccgaaaaccucgaauaccgcaucaugcuaagcguccacggaagccaacacagcggaaugaucgucaacgacaccggacacgaaaccgacgaaaaccgagccaaaguagaaaucacaccaaacagcccccgcgccgaagccacccucggcggcuucggcucccuaggacuggacugcgaaccacgaaccggccuagacuucagcgaccuauacuaccuaaccaugaacaacaaacacuggcuaguccacaaagagugguuccacgacaucccauugcccuggcacgccggagccgacaccgguacaccccacuggaacaacaaagaagcccuaguagaauuuaaagacgcccacgcuaaaagacaaaccgcagucguccucggaucccaagaaggcgccguacacacagcacuagcaggcgcgcucgaagccgaaauggauggcgcgaaaggaagacucagcagcgggcaccucaaaugccgguuaaaaauggacaaacuccgccucaaaggcgucucauacagccucugcaccgcagcuuucaccuucacuaaaauccccgcggaaacucuacacgggacagugaccgucgaaguccaauacgccggaacagacggcccaugcaagguaccagcacaaauggcagucgacaugcaaacccuaaccccgguaggaagauuaauaacggccaacccuguaauaaccgaaagcaccgaaaacagcaagaugaugcucgaacucgaucccccuuuuggcgacagcuacaucguaaucggcgucggcgaaaagaaaaucacccaccacuggcaccgauccggauccacaaucggcaaagccuucgaagcaacgguccggggagccaaacgaauggcgguccugggagacacggcaugggacuucggauccguagguggggcccuaaacucguuaggcaaaggcauccaccagaucuucggcgcagccuucaaaucacucuucgggggaaugagcugguucucgcaaaucuuaaucggaacacuucuaauguggcucggccuuaacaccaaaaacggaagcaucucgcugaugugccuagcacuaggcggaguccucauauuccuaagcacagccguauccgcagacgugggcugcagcguugacuuuagcaaaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9495 - RNA, 2365 nt, Artificial Sequence
  KU497555.1 prME-long mRNA Design 3 opt
gggagaaagcuuaccaugagaaucauaaacgcacgcaaggaaaagaaacggcgcggcgccgacacauccguaggcaucgucggcuuacuccuaacaacagcaauggcagccgaaguaacaaggcgaggaagugccuacuacauguaccuggacaggaacgacgcaggagaagccaucagcuucccaaccacucucggcaugaacaaaugcuauauacaaaucauggaccuaggacauaugugcgacgcaaccaugagcuacgaaugccccaugcuagacgaaggaguggaaccagacgauguagacugcuggugcaacacaaccucaacaugggucguauacggaaccugccaccacaagaaaggugaagcccgacgcucaagacgagcgguaacacucccuagccacucuacccgaaaacuccaaacccgcagccaaacauggcucgaaucccgagaguacacaaaacaccuaauacgaguagaaaacuggauauuccgaaacccgggauucgcccuagccgcagccgcaaucgccuggcuccuaggcagcagcaccucgcaaaaagucaucuaccuagucaugauacuacucauagcccccgccuacagcauccgcugcauaggaguaucgaaccgggacuucguagagggcaugagcggcggcaccugggucgacguaguacuagaacacggcgggugcguuacggucauggcacaagacaaacccacggucgacaucgagcuagucacgaccaccgucucaaacauggcagaaguccgcuccuacuguuacgaagcaucaaucagcgacauggcguccgacuccaggugcccgacccaaggagaagccuaucucgacaagcaaagcgacacacaguauguuugcaagcgcacccuugucgacaggggcugggguaacggcugcggccucuucgggaagggcucccuagucacaugugcaaaauucgcaugcagcaagaaaaugaccggcaaauccauccaaccagaaaaccucgaauaccgcauaauguuaagcguacacggcucccaacauuccggcaugaucguuaacgacaccggacacgaaacagacgaaaaccgagcaaaagucgaaauaacaccaaacagcccccgagcagaagccacccuaggaggauucggaucacucggacuagacugcgaaccgcgaaccggacucgacuucucagaccuuuacuaccuaacaaugaacaacaaacacuggcucguacacaaagaaugguuccacgacauaccacugcccuggcacgccggcgcagacacaggaacgccacacuggaacaacaaagaagcccuagucgaguucaaagacgcacacgccaagcgacaaacagugguaguacucggaacccaagaaggggccguccacaccgcccuggcaggagcacucgaagccgaaauggacggggcgaagggacgccucuccucaggacacuuaaaaugcagacuuaagauggacaaacuccgacuaaaaggagucagcuacagccuaugcaccgcagcauucacguucaccaaaauaccagcugaaacacuccacggcacggucacagucgaaguccaauacgccggcacagacggaccaugcaaaguacccgcccagauggccguggacaugcaaacgcucacccccgucggacgccucauaaccgccaaccccgucauaaccgaauccaccgaaaacagcaaaaugaugcuagaacucgacccucccuucggagacucauacaucgucauaggcgucggcgaaaagaaaaucacgcaccauuggcacagauccggaucaacaauaggcaaagcauucgaagcaacagugagaggggccaagcgaauggcaguccuuggagacacagcaugggacuucggaagcguagguggugcgcuaaacucccuaggcaaaggaauccaccaaaucuucggagcagcauucaaaagccuuuuuggcggaaugucgugguucagccaaauccuaaucgggacgcugcuaauguggcuaggacuaaacacgaaaaacggauccaucucgcugaugugccuagcacuaggcggaguccugaucuuccuuucaaccgccgucuccgcagacguaggcugcucagucgacuucuccaaaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9496 - RNA, 2365 nt, Artificial Sequence
  KX087101.3 prME-long mRNA Design 3 opt
gggagaaagcuuaccaugcgaauaaucaacgcccgaaaagaaaagaaaagacgaggggcagacacauccgucggcauaguagggcuccuccucacaacagccauggccgcagaaguaacccgacgaggcagcgcauacuauauguaccucgacaggaacgacgccggugaggcaauaucguuccccacgacccucgggaugaacaagugcuauauacagaucauggaccucggccacaugugcgacgcaacaaugucauacgaauguccaaugcucgacgagggaguagaacccgaugacguugacugcugguguaacaccaccagcacguggguugucuacggaaccugccaucacaagaaaggcgaagcccgacgcucccgcagagccgucacacugcccucgcauucaacaagaaaacuccaaacacgcucccaaacauggcucgaaucccgcgaauauacaaaacaccucauccgcguagaaaacuggauauucaggaaucccggguucgcccuagccgccgcagcaaucgccugguugcucggcucaagcaccagccaaaaaguaauauacuuagucaugauccuacucaucgcccccgcguacagcauccgcugcaucggagucaguaaccgggacuucgucgaaggcauguccggaggaacauggguggacgucguacuagagcacggaggcugcgugaccguaauggcacaagacaaacccacaguagauauagagcuaguaacgacaaccguauccaacauggcagaaguucgaagcuacugcuaugaagcaagcaucagcgacauggcaagcgacucccgaugccccacccagggagaagccuaccuagacaagcaauccgacacacaauacguaugcaaacgaacccucgucgaccgcggauggggaaacggcugcggccuauucgggaaaggaucccuaguaacaugcgcaaaauucgcaugcagcaagaaaaugaccgguaagagcauccaacccgaaaaccucgaauaccgaauaaugcucaguguacacggcucccaacacagcggcaugaucguaaacgacacaggacacgaaaccgacgaaaaccgugcgaaaguggaaauaaccccgaacucccccagagccgaagcaacccuaggcggcuucggaucacugggccucgacugcgaaccaagaaccggacuagacuucuccgaccuauacuaccucacaaugaacaacaaacacuggcucguacacaaggaaugguuccacgacauaccccuccccuggcacgccggagcagacacagggacaccgcacuggaacaauaaagaagcccuggucgaguucaaagacgcucacgcaaaacgccaaacugucgucguccuuggcagccaagaaggcgccguccacacagcacucgccggugcccucgaagccgaaauggacggagccaaagggcggcuaagcagcgggcaccugaaaugccggcuuaaaauggacaaacuccgacugaaagguguaucauacagccuaugcaccgcagccuucacauucacaaaaauacccgcagaaacacuccacggaaccgucacagucgaacuccaauacgccggaaccgacggacccugcaaagugccagcccaaauggcaguagacaugcaaacgcucacucccguaggccgccuuauaacugcgaaccccgucauaaccgaaagcacagaaaacagcaaaaugaugcucgaacucgaucccccguuuggggacucauacaucgucauuggcgugggcgaaaagaaaaucacgcaccacuggcaccgcucaggcagcacuaucggaaaagcauucgaagcaaccguccgcggcgccaagagaauggcuguacucggcgacaccgcaugggacuucggaucggucggaggggcccucaacagccucggcaaaggaauacaccaaaucuucggcgccgccuucaaaucucuauucggagggaugucgugguuuucccagauccugauaggcacccuccucauguggcuaggccucaacacgaaaaacggcuccauuagccuuaugugccucgcccuaggcggcguauuaaucuuccucucaacagcagucagcgccgacguagggugcagcgucgacuuuucaaaaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9497 - RNA, 2365 nt, Artificial Sequence
  KY075932.1 prME-long mRNA Design 3 opt
gggagaaagcuuaccaugcggaucaucaacgcccgcaaagaaaagaagcgcagaggagcagaaaccuccgucggcauagucggccugcuacuaaccaccgccauggccgccgaagucaccagacgaggcuccgccuacuacauguaccucgacagaaacgacgccggcgaagccaucuccuucccuacaacccucggcaugaacaaaugcuacauacaaauaauggaccuaggccacaugugcgacgccacuaugagcuacgaaugccccaugcucgacgaaggagucgaacccgacgacguggauugcuggugcaacaccacaucgacaugggucguguacgggacgugccaccacaaaaagggagaagccagacgaucacgcagagccgucacacuccccagccacagcacgagaaaacuacaaacacguagccaaacguggcucgaaagccgcgaauacaccaagcaccucauccgcaucgagaacuggauauuccgcaaccccggcuucgcacuagccgcggccgccaucgcauggcuacucggaucgagcaccucacaaaaagucauauaccuagucaugauccuacuaauagcccccgcauacuccauacgcugcauuggcgucagcaaccgggacuucguagaaggcaugagcgguggcacaugggucgacgucguccucgaacacggaggcugcguaaccgucauggcucaagacaaaccuacgguagacauagaacugguuaccacaacagucagcaacauggccgaaguccgcagcuauugcuacgaagcaagcauaucagacauggccagcgacucccguugcccaacacagggagaggcauaccuagacaaacaauccgauacacaguacguaugcaaacguacccucgucgaccgcgguuggggcaauggcugcggccuauucggaaaaggaagccucgucacaugugcaaaauucgccugcaguaagaagaugacaggcaaaucaauccaacccgaaaaccuagaauacagaauaaugcucucgguccacggaagccaacacuccggaaugaucguaaacgacaccggacacgaaaccgacgagaaccgcgccaaggucgaaaucacccccaacucaccacgcgcggaagcaacacugggaggcuucggaucacucggacucgacugcgaaccccgaaccggauuagacuuuuccgaccucuacuaccucacaaugaacaauaaacacuggcucguccacaaggaaugguuccaugacauaccacuacccuggcaugccggcgcggauacgggaacgccccacuggaacaauaaggaggcccucguggaguucaaagacgcccacgcaaaacgccaaaccguaguagugcucggcagccaagaaggagcuguccacaccgcccuggccggagcccucgaagccgaaauggacggggcgaaaggacgccucuccucgggccaccugaaaugccgccuaaaaauggacaaacuccgauuaaaaggggucaguuacagccuaugcaccgcggcauucaccuucacaaaaauaccagcagaaacacuacauggaaccgucacagucgaaguccaguacgccggcacagacgguccauguaaaguccccgcacaaauggccgucgacaugcaaacacugacuccagucggaagacucaucaccgcaaacccaguaauaaccgaaucaaccgaaaacuccaaaaugaugcucgaacucgacccaccauucggcgacuccuacauaguaauaggcgucggagaaaagaaaauaacacaccacuggcaccgaagcggauccaccauuggcaaggcuuuugaagcaaccguacgaggagccaaacgcauggccgugcuaggagacaccgccugggacuucggcuccgucggcggcgcccuaaacucccugggcaaaggcauacaucaaauauucggcgccgcauucaaaucacucuucggaggcaugagcugguucagccagauccucauaggcacccuccuuaugugguugggccucaacaccaagaacggaagcaucucccucaugugccuagcacucggcggcguacucauauuccucucaacagccgucagcgccgacguaggcugcagcgucgacuucucuaaaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9498 - RNA, 2365 nt, Artificial Sequence
  KY014317.1 prME-long mRNA Design 3 opt
gggagaaagcuuaccaugagaauaauaaacgcacgaaaggaaaagaaacgccgaggcgcggacacaagcgugggaauagucggacuccuacucacaacggcaauggcagccgaagucacacgaaggggcucagcuuacuacauguaccuggacagaaacgacgccggggaagcaaucagcuuuccgaccacacuaggaaugaauaaaugcuacauacaaauaauggaccucggacacaugugcgaugcaaccaugucguacgaaugcccaaugcuugacgagggcguagagcccgacgacgucgauugcugguguaacaccacgagcacauggguaguuuauggaacaugccaccacaagaaaggagaagcacgcagaagcagacgcgcugucacgcucccaagucacagcacgcgcaagcuccagacccggagccagaccugguuagaaagccgcgaauacaccaaacaccucaucagagucgaaaacuggaucuucagaaacccaggguucgcacuagcagccgccgccauagccuggcuacucggauccuccacgagccagaaaguaauauaccucguaaugauacuccugaucgcaccagcauacucgauccgcugcauaggcguaagcaaccgggacuucguggaagggaugucaggaggaaccugggucgauguaguucuugagcacggaggaugugugacgguaauggcucaggacaaacccacgguagacauugaacucgucaccaccaccgugagcaacauggcagaagugcgaucauacugcuacgaggccuccauauccgacauggccagugacucaagaugcccaacgcaaggagaagcguaccuagacaaacaaucagacacgcaguacgucugcaaacgaacgcuagucgaccgcggaugggggaacgggugcggacuauuuggcaaaggcucacuggugacaugcgccaaauuugcaugcucaaagaaaaugacaggcaaauccauacaacccgagaaccucgaauaucggaucaugcuauccguacauggcucacaacauagcggcaugauagucaacgacacaggacacgaaacagacgagaacagagccaaagucgaaauaaccccaaauagcccccgcgcggaagcaacccucggaggauucggaagccuaggacuggacugugaaccaagaacaggcuuggacuuuagcgaccucuacuaccugacaaugaacaacaaacacuggcuaguccacaaagaaugguuccacgacauaccgcuaccguggcacgcaggggccgacaccggcaccccgcauuggaacaacaaagaggccuuagucgaguucaaagacgcacacgcaaaaagacaaacgguaguaguacucggcucgcaagaaggcgccguacacaccgcgcucgcaggagcccucgaagcggaaauggacggagcaaaaggucgccugagcuccggccaucucaaaugcagacuaaaaauggacaaacugagacucaaagggguaucuuacagccuaugcacggcagccuucacauucacaaaaaucccugccgagacacuacacgggacggucacagucgagguacaauacgccggaaccgacggaccaugcaagguacccgcccaaauggccgucgacaugcaaacacuaacaccagucgggcgccuaaucacagcuaaucccgucaucacugaaucaaucgaaaacagcaaaaugaugcuagaacuagauccgcccuucggcgacagcuacaucguaaucggcgucggagaaaagaaaaucacacaccacuggcauagaagcgggagcacaauaggcaaagcauucgaagccacaguacgcggagcgaaacgaauggcaguccucggcgacaccgcgugggauuucgggagcgucggcggcgcacucaacucgcucggaaaaggaauccaccaaaucuucggagccgcauucaaaagccuauuuggcggcaugagcugguuuagccaaauacucaucggaacacuccugauguggcucggacucaacacgaaaaacggcagcauaaguuugaugugccucgcccucggagggguacucauauuucugagcacagccgucagcgcagacguagggugcagcguggacuucagcaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9499 - RNA, 2365 nt, Artificial Sequence
  KU758876.1 prME-long mRNA Design 3 opt
gggagaaagcuuaccaugcgcaucauaaacgcccgcaaagaaaagaaacgcagaggcgcagacacaucagucggcaucguaggacuucuacuaacuaccgcgauggcagcagagguaacccgccgcggauccgcauauuacauguaccucgaccgcaacgacgcgggcgaagcaaucucauucccaacaacccugggaaugaacaaauguuacauccaaaucauggaccucggacacaugugcgacgcaaccauguccuacgaaugccccaugcuagacgaaggcgucgaaccagacgacgucgacugcuggugcaacaccaccagcacauggguuguauacggcacgugucaucacaagaaaggagaagcgcgccgaagccgacgcgcagugacgcugcccucccacuccacccgcaaacugcaaacgcgcucccagacauggcuagagagccgagaguacaccaaacaccuaauccgaguagaaaacuggaucuuccgcaacccaggcuucgcacucgccgccgccgcaaucgccuggcuacucggaucuagcaccagccaaaaaguaaucuaccucgucaugauccuccugaucgcucccgccuacagcauccggugcaucggggucagcaacagagacuucguagaaggaauguccgggggaacauggguagacgucguccuagaacacgggggcugcguaacugucauggcucaggacaaacccacagucgacauagaacuugucaccaccaccgucagcaauauggcggaaguacgcagcuacuguuacgaagcaagcauaucagacauggccucugacagccguugcccgacccaaggagaagcauaucucgacaaacaguccgacacccaauacgucugcaaacgaacccucguagaccgaggaugggggaacggauguggacucuucggcaaaggaagccucguaaccugcgcaaaauucgcauguuccaagaaaaugaccggcaaaucaauccaaccagaaaaccucgaauaccgaaucaugcucagcguccacggaucccagcacuccggcaugaucguaaacgauacuggccacgaaaccgacgaaaaccgagccaaagucgaaauaacccccaauagcccacgcgccgaagccacccuaggcggauucggcucccucggccucgacugcgaaccacgcaccggccuagacuucagcgaccucuauuaccuaaccaugaacaacaaacacuggcugguccacaaagaaugguuccacgacaucccccucccuuggcacgccggggcggacacaggaaccccacacuggaacaauaaagaagcacucgucgaguucaaagacgcacacgcuaaaaggcaaaccgucguaguacuaggcagccaagaaggagcaguucacaccgcauuagccggcgcacuagaagccgaaauggacggagucaaaggacgccucuccuccggacaccuaaaaugccgccucaaaauggacaaacuacgccuaaaaggaguaaguuauucacucugcacagcagccuucacauucaccaaaaucccagcagaaacccuacacggcacagugacaguggaaguccaauacgcaggcaccgacggcccaugcaaagucccugcacagauggccgucgacaugcaaacccucacaccagucggcaggcucaucaccgcuaacccaguaaucaccgaaucaaccgaaaacucaaagaugaugcucgaacucgacccgcccuuuggggacuccuacaucgugaucgggguuggggaaaagaaaaucacccaccacuggcaccguucaggaucaacaaucggcaaagcauucgaagcaaccguacgaggcgcaaaaagaauggccguacuaggcgacacagcaugggacuucggcucagucggcggggcccuaaacucccucggcaaaggcauacaccaaaucuucggagcagcauucaagucccucuucggcggcaugagcugguucagccaaauccucaucggcacacugcuaauguggcugggacucaacaccaaaaacggaucgaucucauucaugugccuggcacucgguggcgugcucauauuccucagcacagccgucuccgcagacgucggcugcagcguagauuucucaaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9500 - RNA, 2365 nt, Artificial Sequence
  KU758874.1 prME-long mRNA Design 3 opt
gggagaaagcuuaccaugaggauaauaaacgcccgaaaggaaaagaaacgacgaggagccgacacauccgucggcaucguaggacuccuccuuaccaccgccauggcggcggaggucacacgcagagggucagccuacuacauguaccuagaccgcaacgacgccggcgaagcgaucaguuuucccaccacgcugggaaugaacaaaugcuacauccaaaucauggaccuaggacacaugugcgacgccacaaugucauacgaaugccccaugcucgacgaaggcgucgaaccagacgacgucgacugcuggugcaacacgaccuccacaugggucguguacggaaccugucaccacaagaaaggcgaagcccgacgaucacgcagagccgucacccuacccucccacagcacccgcaaacuucaaaccagaucacaaaccuggcucgaaucccgagaguauacaaaacaccucauacgagucgaaaacuggaucuuccgcaacccaggauuugcccuggcggccgcugccauagccuggcuacucggcuccucaaccucacaaaaggucauauaccucgucaugauccuccuaaucgcccccgccuacagcauccgcuguauaggagucucaaacagagacuuuguagaaggaaugucaggcgggaccuggguugacgugguacuggaacacggcggcugcguaacugucauggcgcaagacaaacccacaguggacauagagcuaguaaccaccaccguaagcaacauggcagaaguacgcuccuacugcuacgaagcaucgaucuccgacauggccucagacucccgcugccccacccaaggcgaagcauaccucgacaaacaaucagacacccaauacgucugcaagcgcacccucguagaccgcggauggggcaacggcugcggccuguucgggaaaggcucccuaguaaccugcgccaaauucgcaugcagcaaaaagaugacuggcaaauccauccaacccgagaaccucgaauacagaaucaugcucucaguccacggaucccaacacuccggcaugauagucaaugacacgggacacgaaacagacgaaaaccgcgcgaaagucgagaucaccccaaacucaccccgagcagaagcaacccuuggaggauucggcagccuaggacucgacugcgaacccagaaccggccuagacuucuccgaccucuacuaucucaccaugaacaacaaacacugguuaguccauaaggaaugguuccacgacaucccccuccccuggcacgcaggcgcugacaccggcacaccccacuggaacaacaaagaggcacucgucgaguucaaggacgcccacgcaaaacgacaaacaguagucguacucggcucccaggaaggcgcaguacacacagcccuagcaggcgcacucgaagcggaaauggacggagcaaaagguaaacuuucaagcggccaccucaaaugccgacugaaaauggacaagcugcgccuaaaaggagucagcuacagucucugcacggccgcauucacauuuacaaaaauaccagccgaaacgcuacacggcaccgucaccgucgaaguccaauacgccggcaccgacggccccugcaaaguacccgcacaaauggccguagacaugcaaacccucacaccgguaggacgccucaucaccgcaaaccccgucauuacagaauccaccgaaaacucaaaaaugaugcucgaacuagaucccccguuuggugacuccuacaucgucaucggaguaggagaaaagaaaauaacacaccacuggcaccgcagcggaucgacaaucggaaaagccuucgaggcaaccgugcgcggcgcaaaacgaauggccguccucggagacaccgccugggacuucggcuccgucggcggggcacuaaacagccuaggaaaaggaauccaucagauauucggagcagccuucaaaucacuguucggaggcauguccugguucucccaaauacugauaggcacacuacucaugugguuaggccucaacaccaaaaacggaagcauaagccucaugugccucgcccucggcggcguccucauauuccucuccacagcggucuccgcagacgugggaugcagcguagacuucagcaaaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9501 - RNA, 2365 nt, Artificial Sequence
  KY014314.1 prME-long mRNA Design 3 opt
gggagaaagcuuaccaugcgaaucaucaacgcacgcaaagaaaaaaaacggcgaggcgccgacaccagcguaggcauaguaggacuccuacuaacaacagccauggccgccgaaguaacccgacgcggcuccgccuacuacauguaucucgaccggaacgacgccggcgaagcaauauccuuccccacaacccucggcaugaacaaaugcuacauacaaaucauggaccucggccauaugugcgacgcaacaaugucauacgaaugccccaugcucgacgaaggcguugagccagacgacgucgacuguuggugcaacaccacaagcaccuggguagucuacggaacaugccaccauaaaaaaggcgaagccagacgauccaggagagcgguaacucugccaucacacuccacacgaaaacuacaaaccagaucccaaacauggcucgaaagccgcgaauacaccaagcaccucauccgcguagagaacuggauuuuccgaaaccccggauucgcccuagccgccgccgccaucgccuggcuucugggauccucgaccagccaaaaaguaaucuaccucgucaugauccucuuaauagcccccgcguacagcauacgaugcaucggaguaucgaaccgcgacuucguagagggaaugagcggcggcacauggguagacguaguacucgagcacggagguugcguaacagucauggcacaagacaaaccuacaguggacaucgaacucguaacgaccaccgucagcaacauggcggaagugcgcucauacugcuacgaagcaucgauaagcgacauggccuccgacucccgcugcccaacgcaaggcgaagccuaccucgauaaacaguccgacacccaguacgucugcaaacgcaccuuagucgacaggggauggggaaacggcugcggccuauucggcaaaggcagccuugucaccugcgccaaauucgcgugcagcaaaaaaaugacaggaaaauccauccaacccgaaaacuuagaguaccgcauaauguuaucaguccacggaucccaacacucaggaaugaucgucaacgauacaggccacgaaacagacgaaaaccgcgccaaagucgaaaucacacccaacuccccccgcgcagaagccacccuaggcggguucggaagccucggacuagacugcgagccccgcacaggacuugacuucagugaccuauacuaccuaacaaugaacaacaagcacuggcucguccacaaagaaugguuccacgacaucccccuacccuggcacgcaggagccgauaccggcacaccucacuggaauaacaaagaagcgcuagucgaauucaaagaagcacacgcaaaacgacaaacaguaguaguguuaggcucacaagaaggcgcaguccacaccgcgcuagccggagcccuagaagcggaaauggacggcgcaaaaggccgccuaucaagcggccaucuaaagugucgacuaaaaauggacaaacuccgacugaaaggcguauccuauagccugugcaccgccgcauucaccuucacaaaaauccccgcagagacccuucacggaacggucacuguagaaguccaguacgcaggcaccgacggaccaugcaaaguccccgcacaaauggccguugacaugcaaacccuaacaccagucggaagacucauaaccgccaacccagucaucacagaaaguaccgaaaacagcaaaaugaugcucgaacucgaccccccguucggcgacagcuacaucgugaucggcguaggcgaaaaaaaaauaacgcaccacuggcauagaucaggcagcaccauaggaaaagccuucgaagcaacaguacgcggcgcaaaacgaauggccguacucggcgacacggcaugggacuucggcuccgugggcggagcgcugaauagucugggcaaagguauccaccaaaucuuuggggccgcauuuaaaucccucuucggcggcaugucaugguucucacaaauccuaauaggaacacuucugauguggcugggacucaacacgaaaaacggcuccaucucccugaugugccuagcacucggcggcguacugauauuccuauccacagcagucucagcagacguaggcugcucggucgacuucagcaaaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9502 - RNA, 2365 nt, Artificial Sequence
  KU926310.1 prME-long mRNA Design 3 opt
gggagaaagcuuaccaugcgaaucaucaacgcaaggaaagaaaagaaaagacggggcgcggacacaagcgucgggaucgucggucuacuacucacaaccgcaauggccgcugaagucacccgcagaggcagcgcauauuacauguaccuggacagaaaugacgcaggagaggcaaucagcuuccccacaacgcuaggcaugaacaaaugcuacauacaaaucauggaccuaggacacaugugcgaugcgacaaugagcuaugagugccccaugcucgacgaaggagucgaaccagacgaugucgacugcuggugcaacaccacaagcacgugggucguauacggcacaugccaccacaaaaagggcgaagcacgacgaagcagacgagccgucacacugccaucacacuccacacgcaaacuccaaacacggagccaaacauggcuggaaucccgggaauacaccaaacaccucauccgggucgaaaacuggauauucagaaacccaggauucgcccucgcagcugccgccauagcauggcuccuaggcucaagcacaucacaaaaagugauauaccuuguaaugauacuacucaucgcgcccgccuacucaauacgaugcauagggguaagcaaucgcgauuucguggaagguaugucagguggcaccuggguagacgucgugcucgagcacggaggauguguaacgguaauggcacaggacaaacccacggucgacaucgagcucgucaccacgacgguaagcaacauggccgaaguacgcucauacugcuacgaggcguccauaucagacauggcaucagacagccgcugccccacccagggagaggcauaccuggacaaacaaagugauacacaauacguaugcaaacggacgcucgucgacagaggcuggggcaacggauguggacuauucggcaaaggaagccuaguaacgugcgccaaauucgccugcagcaagaaaaugacaggaaaauccauacaaccagaaaaccuagaauaccgaauaaugcucucaguacacggcucacaacacaguggcaugauaguaaacgacaccggccaugaaacugacgaaaaccgcgccaaagucgaaaucacccccaacagcccgcgagcagaagcaacacucggaggauucggauccuuaggacucgacugcgaaccacgcacaggacucgauuucagcgaccucuacuaccucacgaugaacaauaaacauuggcuaguccacaaagaaugguuccacgacaucccccuacccuggcacgcaggcgccgacacaggaacaccccacuggaacaacaaagaagcacugguagaguucaaagacgcacacgccaaacgccagacagucgugguccuaggaucacaggagggggcaguccacaccgcacucgccggagcccuagaagccgagauggacggagccaaaggaagacucagcucgggccaccucaaaugcagacuaaaaauggauaaacuaagacucaaaggugucuccuacucccucuguacagccgccuucacauucaccaaaauaccagccgagacgcuacacggcaccguaacagucgaggugcaguacgcaggcgcggacggaccaugcaaggugccagcccaaauggccguagacaugcagacccucacaccgguaggccgacuaauaaccgccaaucccguaauaaccgaauccaccgaaaacucaaaaaugauguuagaacuggacccgcccuucggggacagcuacauagucaucggagugggagaaaagaaaaucacacaccacuggcacagaaguggaagcacaauagggaaagcguuugaggccaccguacgcggcgccaaacgcauggcaguccuaggagacaccgcaugggacuucggcagcgucggcggagcacucaacucacugggcaagggaauccaccaaauuuucggcgcagcauucaaaagccuauucggaggaaugagcugguucucacaaauacugaucggcacacuacuaauguggcugggacugaauaccaaaaacggaagcaucaguuuaaugugccuugcacuaggaggcguacugauauuccuaagcacagccgucuccgcagacguggggugcagcguagacuucagcaaaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9503 - RNA, 2365 nt, Artificial Sequence
  KU761560.1 prME-long mRNA Design 3 opt
gggagaaagcuuaccaugagaauaauaaacgcagggaaagagaagaaacgaaggggagccgacacaaacgucggcaucgucggacuauugcuaacaacggcgauggcagccgaaguaacacgccgcggaucagcguacuacauguaccuggaccgaaacgacgccggagaagcaaucuccuucccaaccacgcucggcaugaacaaaugcuacauccaaauaauggaccuaggacacaugugcgacgccaccauguccuacgaaugcccgaugcucgacgaaggcgucgaaccagacgaugucgauugcugguguaauaccacgaguacaugggucgucuacggcacaugccaucacaagaaaggagaagcacgcagaagcagacgcgccguaacacuaccaagccauuccacaagaaaacuacagacaaggagccaaacauggcuggaaagccgcgaauacacaaaacaccuaaucagaguggaaaacuggaucuucaggaauccaggauucgcacuggccgcggcggcaauagcguggcuccuaggaagcaguacaucacaaaaaguaaucuaccucguaaugauauugcugaucgcgccagccuacucuauaaggugcauaggagucagcaaccgugacuucguagaaggaauguccggcggcaccugggucgacgucgugcucgaacacggagggugugucaccguaauggcccaagacaaacccaccguagacauagaacuggucacaacgaccguaagcaacauggcagaagugcgcagcuacugcuacgaggccucaaucagcgacauggcaagcgacucccgcugcccaacacaaggcgaagcauaccuggacaaacagagcgacacccaguaugucugcaaaaggacccucgucgaccgaggauggggaaacggaugcggccuauucggcaaaggaucccuagugacgugcgccaaauucgcaugcaguaagaaaaugaccggcaaaagcauacaaccagaaaacuuagaauacaggaucaugcucucagugcacggaucacaacacagcggaaugauagucaacgacaccggccacgaaacggacgaaaacagagccaaagucgaaauuacacccaacaguccacgcgcagaagcgacccucggaggguucgggagcuuaggacucgacugcgaaccacgaacgggacucgacuucagcgaccuguauuaccuaacaaugaacaacaaacauuggcuagugcacaaagagugguuccacgacaucccccuaccauggcacgccggggccgacacaggcacaccccauuggaacaacaaagaagcucuagucgaguucaaagacgcacacgcaaaaaggcaaaccgucgugguacuuggcagccaagaaggcgcaguccacacugcacuagcaggagcgcuagaagccgaaauggacggagcaaaaggccgccuauccucggggcaccucaaaugcagauugaaaauggacaaacuaagacugaaaggaguaucauacucccucugcaccgcugccuucaccuucaccaaaauacccgcagaaacccuccacggaacgguaacagucgaaguacaguaugccggaaccgacggccccugcaaggucccagcccaaauggccgucgacaugcaaacacuaaccccaguuggccgccuaaucacggccaacccaguaaucacagaaucaaccgagaacuccaaaaugaugcucgaacucgacccacccuucggagacagcuacaucguaaucggcgucggcgaaaagaaaauaacccaccacuggcaccgcagcggaagcacaauuggcaaagcguucgaagcaacggucagaggcgcacgcagaauggcaguucucggcgauacagcaugggauuucggcagcguaggaggggcgcucaacucccucgggaaaggcauacaucaaaucuuuggggcagcguucaaaagccuguucggcggcaugucaugguucagucaaauccuaauaggaacacuccuaauguggcucgggcuaaacacgaaaaacggguccaucagcuuaaugugccucgcacucggaggaguacucaucuuccuauccacagcuguaagcgcagacgucggaugcucaguggacuucucaaaaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9504 - RNA, 2365 nt, Artificial Sequence
  KY317939.1 prME-long mRNA Design 3 opt
gggagaaagcuuaccaugcgcauaaucaacgccagaaaagagaagaaacgacgaggagcagaaaccagcguggggauagugggccugcuccuaaccacagcaauggcugccgaagugacacgaagaggaagcgccuauuacauguaccuggacagaaaagacgcaggagaagccaucagcuuuccaaccacacucgggaugaacaaaugcuacauccagauaauggaccuaggccacaugugcgacgcaaccaugucauacgaaugccccauguuagacgaaggcguggagccggacgacguagacugcuggugcaacaccaccagcacuugggugguguacggaacaugccaccacaagaaaggcgaagccagacgcagcagacgagccgucacgcuccccagccacuccacacggaaacuacagacacgaagccaaacauggcuagaaagccgcgaauacaccaaacaccuaaucagagucgagaacuggaucuuccgcaaucccggcuucgcauuagccgcagccgcaauagccuggcuacuaggcagcagcacaucccaaaaaguuaucuaucuugugaugauacugcuaauagcccccgcguacucaauccggugcaucggcgucucaaaccgggacuucguagaaggcaugucaggcggcaccugggucgacgucguacuagaacauggaggaugcgucaccguaauggcccaagacaaacccaccguagacaucgaacucgucacgacuaccgucaguaacauggcagaagugcgauccuacugcuacgaagccagcaucuccgacauggccuccgacagccgcugcccaacacaaggcgaagcauaccucgacaaacaaagcgacacacaauacgugugcaaacgaacccuagucgaccgcggaugggguaacggaugcggccucuucggaaagggcagccuagugaccugcgcaaaguucgcaugcagcaagaaaaugacaggcaaaaguauccagccagaaaaucuggaguacagaauaaugcuuucaguacacggaucacaacacucaggaaugaucgucaacgacacaggccaugaaacagacgagaaccgcgcgaaaguagaaauaacccccaacagccccagagcagaagcaacacucggaggguucggcagccuaggacucgacugcgaaccacgaaccgggcuagacuucagcgaccuauacuacuuaacaaugaacaauaaacacuggcucguucacaaagaaugguuccacgacaucccccuaccauggcaugcaggagccgacaccggaacgccccacuggaacaacaaggaggccuuaguagaguucaaggacgcacacgcgaagcgacaaaccguagucguccuaggaucccaagaaggagccguacacacagcacuggccggcgcccucgaagcagaaauggacggggcaaaaggccgacuaagcagcggccaccuaaagugcagacugaagauggacaaacugagacucaaaggcgucuccuacagccucugcaccgccgcauucacauucaccaagauaccagcggaaacacuacacggaaccgucaccguagaagugcaauacgcaggcacugacggccccugcaaagucccagcacaaauggcaguagacaugcaaacacucacaccaguaggacgacucaucaccgccaacccaguuaucaccgagucaacagaaaacucaaaaaugaugcucgaacucgacccgcccuucggcgacagcuacaucguaauaggagugggagaaaagaaaauaacgcaccacuggcaccggagcggcagcacaauaggaaaagcauucgaagcaacagucagaggcgccaaaagaauggccguccucggcgacacggcaugggacuucgggagcgucggaggcgcauuaaacucccuggggaaaggaauccaccaaauuuucggagccgccuucaaaagccuauucggcgggaugucaugguucagccaaauccucauugggacccuacuaauguggcuaggccugaacacgaagaacggaagcauaucacuaaugugccuagcacuagggggaguccuaauauuccuauccacggcgguaagcgcagacguaggaugcuccguagacuucagcaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9505 - RNA, 2365 nt, Artificial Sequence
  KY075937.1 prME-long mRNA Design 3 opt
gggagaaagcuuaccaugcgaaucaucaacgcgagaaaagaaaagaaaagacguggagcggacacguccgucggaaucgucggacuauugcuaacgacggcuauggccgcggaagucacacgcagaggcagcgccuacuacauguaccucgaccgcaacgacgcuggcgaagcgaucagcuuccccaccacccuuggaaugaacaaguguuacauccagauaauggacuuaggacacaugugcgacgccaccauguccuacgaaugcccuaugcuugacgaaggcgucgagccagacgacguggauugcuggugcaacacaaccagcacauggguaguauacggaaccugccaucacaagaaaggcgaagcccgaaggaguagacgagccguaaccuuaccaucgcacucaacacgaaaacuacaaacccgcucccaaacauggcuagaaucccgcgaauacacaaaacaccucauccgcgucgaaaacuggauauuccgcaaccccggauucgcacuagccgccgccgcaaucgccuggcuacucggaagcucaaccucgcaaaaagucauauaccucguaaugauacugcuaauagcaccggcauacuccauacgauguaucggcguguccaacagggacuucgucgaaggaauguccggaggaaccugggucgacgugguacuagagcacggaggcugcgucacagugauggcccaggacaaaccaacagucgacauagagcuagucacaacaaccguguccaacauggccgaaguaagguccuacugcuacgaagccagcauaagcgacaugguaucagauucgcgaugccccacccaaggcgaagcauaccucgacaaacaaagcgacacccaguacguaugcaaacgcacgcucgucgacagaggauggggcaacggaugcgguuuauucggcaaaggaagccuaguaaccugcgcaaaauucgccugcaguaagaaaaugaccggaaaauccauacaaccagaaaaccuagaauaccgcaucaugcucuccguccacggaucacaacacagcggaaugauagucaacgacacgggacacgaaaccgacgaaaacagggccaaaguagaaauaaccccaaacaguccccgugcagaagcaacacucggcggguucggcucacucggccucgacugcgaaccaagaaccggccuagacuucuccgaccucuacuaccuaacaaugaacaacaaacacuggcucguacacaaagaaugguuccacgacauaccccuaccauggcacgccggcgccgacaccggcacuccacacuggaacaacaaggaagcccucguagaguucaaagacgcacacgcuaaacgccaaaccgucguaguccucggaagccaggaaggagccguccacaccgcccuggcaggggcccuggaagcugaaauggacggagcaaaaggcagacucucaagcggccaccuaaagugccgacucaaaauggacaaacucagacuaaagggaguaagcuacagccucugcacagccgcauucacauucaccaaaaucccagccgaaacucuacacggcacagucaccguagaaguacaauacgccggaacagacggaccguguaaaguaccagcucaaauggccguggacaugcaaacacugacacccgucggaagacucauaaccgccaacccagucauaaccgaaucgaccgaaaacagcaagaugaugcuagaacuagacccgcccuucggagacagcuacaucguaaucggcguaggggaaaagaaaauaacccaccacuggcacagaucaggcuccacaauaggaaaagccuucgaagccacaguacgaggcgccaaacgaauggcuguauuaggugacacggcaugggacuuuggaucaguaggcggcgcccuaaacucacuaggaaaaggcauccaccaaaucuucggggcagccuucaagucgcucuuugggggcauguccugguucucgcaaauccucaucgggacccuccuaauguggcuaggacucaacaccaagaacgguucgauaucccugaugugccucgcucucggaggaguccucaucuuccucuccacugccgucagcgccgacguuggcugcucggucgauuucuccaaaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9506 - RNA, 2365 nt, Artificial Sequence
  LC191864.1 prME-long mRNA Design 3 opt
gggagaaagcuuaccaugagaaucauaaacgcaagaaaagaaaagaaaagaagaggcgcggauaccaaugucggaaucgugggacuccuacuaacaacggcaauggcagcggaaguaacccgacgaggcagcgcauacuacauguaccucgacagaaacgacgcaggagaagcaaucagcuuccccaccacucuaggcaugaacaaaugcuacauccaaauaauggaccucgggcacaugugcgacgcgacaauguccuacgaaugccccaugcuggacgaaggcguagaacccgacgacgucgacugcuggugcaacaugacgagcacauggguaguauacgggacgugccaccacaagaaaggcgaagcacgacgaagccgccgggcaguaacccucccaagccacagcacgcgcaaacuacagacucgcucacaaaccuggcucgagagccgagaauacacaaagcaccuaauccgcguagaaaacuggaucuuccgaaaccccggcuucgcacuagcagcagcagcgauagcguggcuacugggcucaagcaccagucagaaagucaucuaccugguaaugauacuacuaauagcaccagccuacagcaucaggugcauaggcguaagcaaccgagacuucguagaaggaaugagcggaggcaccuggguggacgucguucucgaacacggagggugcgucacaguaauggcccaagacaaacccacaguggacaucgagcuaguaacaaccacagucagcaacauggcagaaguccgcucauacugcuacgaagccuccaucuccgacauggccagugacucacgcugcccaacacaaggagaagccuaccucgacaaacaaucagacacacaguacgucugcaaacgcacacuggucgaccgcggauggggaaaugggugcggacuauucggaaaaggaucccucguaaccugcgccaaauucgccugcaguaagaaaaugacaggcaaaucaauccagccggaaaaccuagaauaccgcaucaugcucagcguccacggcagccaacacagcgguaugauaguaaacgacacaggacacgaaacagaugaaaaccgcgcaaaagucgagaucacacccaacagcccccgcgccgaagcaacccuagguggguuuggcagccugggacuagacugcgaaccacgaaccggacucgacuucuccgaccuauacuaccuaacuaugaacaauaaacacuggcucguacauaaggaaugguuccacgacaucccacuaccauggcacgcuggagccgacaccggaaccccgcacuggaacaacaaagaagcgcucguagaguucaaagacgcacacgccaaacgacaaacagucguuguacucgguagccaggaaggagcaguacacacagcacucgccggagcacuagaagcagaaauggacggagcaaaaggacgacugagcagcggccaccugaagugcagacucaaaauggacaagcuccgccucaaaggagucagcuacagccucugcaccgccgcguucaccuucacaaaaauaccagcggaaacacuucacggaacgguaacaguggaaguacaauacgccggaacagacggacccugcaaagucccagcccagauggccgucgacaugcaaaccuuaaccccagucggccgccuaaucaccgcaaaccccgucaucaccgaauccaccgaaaacuccaaaaugaugcuggaacuagacccacccuuuggagacuccuacaucguuauaggaguaggcgagaaaaagaucacccaccacuggcaccgcuccggaagcacgaucggcaaagccuucgaagccaccguccggggagccaaacgcauggcaguacuaggagacacagcaugggacuucggaagcgugggcggggcccugaacagccuaggcaaaggaauccaccagauauucggcgccgccuucaaaagccuauucggcggcauguccugguucucgcaaauacuuaucggcacacuauuaauguggcucggacucaacacaaagaacggcucaaucagccuaaugugucucgcucugggaggaguccuaauauuccucagcacggcagucagcgcggacgucggcugcucagucgacuucuccaaaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9507 - RNA, 2365 nt, Artificial Sequence
  KX447517.1 prME-long mRNA Design 3 opt
gggagaaagcuuaccaugcgcauaaucaacgcccgaaaagagaaaaagcgacgcggggccgacacgagcgucgguauaguaggccuacuucugaccacagccauggcggccgaagucacgcgccggggcagcgccuacuacauguaccuagaccgaaacgacgcaggagaagcaaucagcuucccaaccacgcuaggcaugaacaaaugcuacauacaaaucauggaccuaggucacaugugcgacgcaaccaugagcuacgaaugcccuaugcuagacgaaggagucgaacccgacgacguggacugcuggugcaacaccacaagcacaugggucgucuacggaaccugccaucacaaaaagggcgaagcacgcagaagccgacgcgccgucaccuugccaagccacagcacccggaaacugcaaacaagaagccaaacguggcuagaaagucgcgaauauaccaaacaucucauacgcgucgaaaacuggaucuuccgaaaccccggcuucgcacucgcagcggccgcaauagcauggcuccuaggguccagcacaagccaaaaaguuaucuaccucguaaugauccuacucaucgcuccagcauacuccauacgaugcaucggcgucagcaaccgagauuucgucgaaggaauguccggaggcaccuggguagacgucguacucgagcacggcggcugcgucaccgucauggcccaagacaaaccaacugucgacauagaacucgucaccaccaccgucucaaacauggccgaagugcgcagcuacugcuacgaagcgagcaucagcgacauggccagcgacuccagaugucccacucaaggagaagccuaccucgacaaacaauccgacacccaauacgugugcaaacgcacgcuagucgaccgaggauggggaaauggaugcggacucuuuggaaaagguucguuaguaaccugcgccaaauucgcaugcuccaaaaagaugacaggcaaaucaauacagccggaaaaccucgaauacagaaucaugcucagcguccacggcagccaacauagcggaaugaucguaaacgacacgggacacgaaacagaugaaaauagggcaaaagucgagaucaccccuaacaguccccgagccgaggcggcacuaggcggauucggaucacuaggacucgacugcgagccccgcacuggccuggacuucuccgaccucuacuaccucaccaugaacaacaaacacuggcuagugcacaaggaaugguuccacgacaucccccuacccuggcacgccggcgccgacaccggaacuccccauuggaacaacaaagaagcacuggucgaauuuaaagacgcacacgcgaaacgacaaacagucguaguacucggaucccaagaaggugccguccacacagcacuagccggagcgcuggaggcagagauggauggcgccaagggccggcucuccuccggccaccuaaagugucgucuaaaaauggacaaacuccgccuaaaaggcgugucguacagccuaugcaccgcagccuucaccuucaccaaaauccccgccgagacacuacacggaaccgucacagucgaaguccaauacgccggcacagacggcccgugcaaagugccggcccaaauggcaguggacaugcagacccuaacaccagucggacggcuaaucacagccaaucccguaaucacagaaagcacagaaaacagcaaaaugauguuagaacuagaucccccauucggcgacagcuacauagucauaggcgucggagagaagaaaauaacacaccacuggcacagaagcggcagcacaaucggaaaagcauuugaagcaaccguccgcggagcaaaaagaauggcaguacugggcgacaccgcaugggacuucggaucaguaggcggcgcacuaaacucauuaggcaaagggauacaccaaauauucggagcugcauucaaaagccucuucgggggcaugagcugguucucacaaacacucaucggcacccuacugauguggcugggacuaaauaccaaaaacggaagcaucucgcucaugugccucgccuuaggaggaguccuaaucuuccucagcaccgcuguaagcgccgacgucggcugcagcgucgacuucucaaaaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9508 - RNA, 2365 nt, Artificial Sequence
  KU922923.1 prME-long mRNA Design 3 opt
gggagaaagcuuaccaugcgcauaaucaaugccaggaaagaaaagaaaaggcgcggcgcagaaaccucagugggaaucgucggacuacuacugaccacagcaauggccgccgaggugacacgacgcggaucugccuacuacauguaccuagaccgaaacgacgcuggcgaagcgaucuccuuccccacaacccucggaaugaauaaaugcuacauacaaauaauggaccuaggccacaugugugacgccacaauguccuacgaaugcccaaugcucgacgaagguguggaacccgacgacguggacugcuggugcaacacaacgucaacguggguaguauacggaaccugccaccacaagaaaggagaagcaagaagaagccgacgagcuguaacacucccgagccacagcacgcgaaaacuccaaaccagaagccaaacguggcuagaaagcagagaauacaccaaacaccuaauacgcgucgagaacuggauauuucgaaaccccggauucgcacucgcagccgccgcaauagccuggcuacuaggcaguucaaccagucaaaaagucaucuaccuaguuaugauacuacucaucgcacuagcauauagcauccgauguauaggggucucaaaccgcgacuucguagagggaaugagcggcggcaccuggguagacgucguccucgaacacggcggaugcguuaccguaauggcgcaggacaaacccaccguggacauagagcuaguuaccacgacaguaagcaacauggcggaagucagaucauacugcuacgaagcaagcaucagcgacauggcaagcgacagcagaugcccaacgcaaggagaagccuaccucgacaaacagagcgacacacaauacgucugcaaacgcacgcuuguagaccgaggauggggcaacggaugcggacuguucggaaaaggcucauuagucacaugcgccaaauucgcgugcagcaagaaaaugaccggaaaaaguauccaacccgaaaaccucgaauaccgaaucaugcucuccguccacggaucacagcacagcggaaugauaguaaacgacacaggacacgaaaccgaugaaaaccgggcgaaaguagaaaucacuccaaacuccccuagagcggaagccacacuaggcggcuucggaagccuaggccucgacugcgaaccacgcacgggccucgacuucagcgaccucuacuaccuuaccaugaacaacaaacacuggcugguacacaaagaaugguuccacgacaucccccuaccauggcacgcaggagcagacacaggcacaccccacuggaacaauaaagaggcacucgucgaguucaaagacgcccacgcaaaacgacaaaccgucgucguccuaggaagucaagaaggcgcgguccacacggcacucgccggugcgcuagaagcagagauggacggcgcgaaaggacgacuaagcuccggacaucucaaaugcaggcucaaaauggacaaacuccggcugaaaggaguaagcuacucgcucugcaccgcugccuucacauucaccaaaauccccgccgaaacacuccacggcaccgucaccgucgagguacaauacgcaggcacagauggaccgugcaaagucccagcacaaauggccguagacaugcaaacacugacacccgucggacgacucaucaccgcuaaccccgucaucaccgaaaguaccgagaacagcaaaaugaugcuagaacucgacccgcccuucggagacucauacaucguaaucggagucggggaaaagaaaauaacacaccauuggcaccgauccggcuccacuauaggaaaagcguucgaagccacgguacgcggugccaaacgaauggcaguccucggcgacaccgccugggacuucggaagugucggaggcgcauuaaacucccucggcaaaggaauacaccaaaucuucggcgccgcauucaaaagccuauucggaggaauguccugguucucccaaauacugauagggacacuccucauguggcucggucuaaacaccaaaaacggaagcaucucccucaugugccuugcccuuggaggaguacucaucuucuugucaacagccguaagugcugacgucggcugcagcgucgacuucuccaaaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9509 - RNA, 2365 nt, Artificial Sequence
  KY003156.1 prME-long mRNA Design 3 opt
gggagaaagcuuaccaugcgaaucauaaacgcuaggaaagagaagaaacggcgaggagcggacacauccgugggaauaguuggccugcuccuaacaaccgcaauggcggcagaaguaacgcgccgaggcuccgccuacuacauguaccuagaccguaacgaugcuggggaggcaauauccuucccuaccacccucggcaugaacaaaugcuacauccaaauaauggaccucggacacaugugcgacgccacaauguccuacgagugcccgaugcuagacgaaggcgucgaaccagacgacgucgacugcuggugcaauacaaccagcaccugggucguauacggcacuugccaccacaagaaaggagaagccagacgcagcagacgagccgucacgcucccaagccacuccacccgcaaacuacagacccgaucccaaacauggcucgaaagccgagaauacacaaaacacuuaauccgcgucgagaacuggaucuuccgcaaccccggcuucgcacucgcagcggccgccauagccuggcuccucgggagcagcaccucccagaagguaaucuaccuggugaugauacuccuaauugcacccgccuacuccauacggugcauaggcauauccaaccgagacuucgucgaaggcaugucaggaggaaccugggucgacgucguucuagaacacggaggcugcguaaccgucauggcccaagacaaaccaacagucgacauagagcuagucaccacaaccgucuccaacauggccgaagucagaaguuacugcuacgaggcaagcaucagcgacauggccagcgacagccgcugccccacacaaggagaagcauaccucgauaaacaaucagacacccaauacgucugcaaacgcacacugguagacagaggauggggcaacggcugcggucucuucgggaaaggcucacugguaaccugcgccaaauucgccugcuccaagaaaaugacagggaaauccauacaaccagaaaaccuagaauaccgcauaaugcuaucuguccacggaucacaacacuccggcaugauaguaaacgacaccgggcacgaaaccgacgaaaacagagccaaaguagaaaucacccccaacagcccccgcgcggaagcaacacucggaggauucggcauacuaggacuggacugcgaacccagaaccggacuggauuucagcgaccuuuauuaccucacaaugaacaauaaacacuggcugguccauaaagaaugguuccacgacauacccuuacccuggcaugcgggagcagacacaggcacaccgcacuggaacaauaaagaagcccucgucgaguucaaagacgcccacgcaaaaaggcaaaccgucguaguccugggcucccaagaaggagccguacacaccgcacucgccggcgcccuagaagcagagauggacggggccaaaggccgacuaagcuccggccaccucaaaugccgucuaaaaauggacaaacuacgcuuaaagggcgugucauacucacucugcacagcagccuucacauucaccaaaauaccggcagaaacacugcacggcacagucacaguggaagugcaauaugccggcacagacggcccauguaaagucccagcccaaauggcaguagacaugcaaacgcuaacaccagugggccgccuaauaacagccaaccccgucaucacagaaaguacagaaaacucaaaaaugaugcuagagcuagaucccccauuuggcgacucauacauaguaauaggcgucggcgaaaagaaaaucacccaucacuggcaccgaucaggaagcacaauuggaaaagccuucgaagcgacaguaagaggagccaaacgaauggcaguacugggagacacagccugggacuucggaagcgugggcggagcacugaacucgcuaggaaaaggcauccaccagaucuucggcgcagccuucaagucacucuucggcggcaugagcugguucucccagauacucaucggcacgcuccucauguggcuaggacuaaacacgaaaaacgguagcaucucacugaugugccucgcccucggaggaguccucauauuccuaucgacagccguaagugccgacgugggaugcuccgucgacuucuccaaaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9510 - RNA, 2365 nt, Artificial Sequence
  KU312313.1 prME-long mRNA Design 3 opt
gggagaaagcuuaccaugcgcaucauaaacgccagaaaagaaaagaaaaggcguggcgccgacacauccguaggaauagucggucuacuacucaccacagccauggcagccgaagucacaaggagaggcucagcauacuacauguaccucgaccgcaacgaugccggagaggccauuucauucccaacaacccuaggaaugaacaaaugcuacauccaaauaauggaccucggccauacaugcgacgccacaauguccuacgaaugcccuaugcucgacgaaggaguagaaccggacgacgucgacugcuggugcaacaccaccucaaccugggucguguacggaacaugccaccacaagaaaggagaagccagacgcagccgccgggcagugacccuccccucccacucgauccgcaaacuccaaacacgcagccaaaccugguuagaaucacgagaauacaccaaacaucuaaucagggucgaaaacuggaucuuccgaaacccaggcuucgcacucgccgcagccgcaauagcgugguuacucggaagcuccacaagccaaaaagucaucuaccucguaaugauacuucuaauagcaccagccuacagcauccgcugcaucggagucagcaaccgagacuuugucgagggcaugagcggcggcaccuggguggacgucguacucgaacacggcggcuguguuacggucauggcccaggacaagcccacagucgauauagaacucgucacuacaaccgucagcaacauggcugaaguacgaagcuacugcuacgaggccuccauaagcgacauggcaagcgacucccgcugccccacccaaggcgaagcauaccuugauaaacaauccgacacacaauauguaugcaaacgcacacucguagacagaggguggggaaacgggugcggacucuucggcaaaggaucccucguaaccugcgccaaauucgccugcuccaaaaagaugaccggaaagagcauccaacccgaaaaccucgaauaucggaucaugcucuccguccacggaucccaacauagcggaaugaucguaaacgacacagggcacgaaaccgacgaaaaccgcgcaaaaguagaaaucaccccgaacagcccccgcgcggaagccacccucgggggcuucggaagccugggccucgacugcgaaccccgaacaggacuagacuucuccgaccucuacuaccuaaccaugaacaacaaacacuggcucguccacaaagaaugguuccacgacauaccccuaccauggcacgcaggcgccgacacgggcacaccgcacuggaacaacaaagaggcauuagucgaauuuaaggacgcgcacgcaaaacgccagacaguagucgugcugggcucacaagaaggcgccguacacaccgcccuugccggcgcacuagaagcagagauggacggcgcaaaaggcagacuauccuccggccaccuaaaaugcagacuaaagauggacaaacuccggcugaaaggaguguccuacagccuuugcaccgcugccuucacguucacaaaaauccccgccgagacccuccacggaacgguaacaguagagguccaguacgcaggcaccgacggaccgugcaaagucccagcccaaauggccgucgacaugcaaacgcucacccccgucggccgacugauaaccgcgaacccagucaucaccgaguccaccgaaaacuccaaaaugaugcuagaacuagacccaccauucggggacucauacaucgugauaggaguaggcgaaaagaaaaucacccaccacuggcaucguuccggcuccacaaucggcaaagcauucgaagccacagucagaggcgccaaacgaauggccgugcucggagacaccgccugggacuucggaagcguaggcggcgcccucaacucccucggaaaaggaauccaccaaaucuucggggccgccuucaagucccucuucggcggaaugucaugguucucucagauacucaucggaacucugcucauguggcuagggcuuaacgccaagaauggcucgaucucacucaugugccuagcauuaggaggaguccucauauuccuaagcaccgcgguauccgcagacguagggugcagcgucgacuucaguaaaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9511 - RNA, 2365 nt, Artificial Sequence
  KY075935.1 prME-long mRNA Design 3 opt
gggagaaagcuuaccaugcgaauaauaaacgccagaaaagaaaagaaacgacgaggagccgacaccucaguaggcaucguaggacuacuacucacgacagcaauggcagcagagguaacccgccgcgggagugcauacuacauguaccuugacagaaacgacgcgggagaagcgauauccuucccaacaacgcucgggaugaacaaaugcuacauccaaauaauggaccucgggcauaugugcgacgcaacaaugucguacgaaugcccaaugcuagacgaaggcguagaaccagacgacgucgacugcuggugcaacacaaccagcaccugggucguauacggcacgugucaccacaagaaaggagaagcccaacgcuccaggcgagccgucacgcuccccagccacagcacccgaaaacuccaaacccgcagccagacauggcucgaaucaagagaauacaccaaacaccuaauacgagucgaaaacuggaucuuccgcaaccccggauucgcccucgcagccgcagcgauagcguggcuccugggcagcaguaccagccagaaaguaauauaccuugucaugauacuccucauagcccccgccuacaguauacgcugcauaggcguaagcaaccgcgacuucguagaaggaaugagcggcggaacaugggucgacguggucuuagaacacggcggcugugugacaguaauggcacaagacaagcccaccguagacauagaacuggucacaacaacaguaagcaacauggcagaaguccgcucguacugcuacgaggcuucaaucuccgacauggcaucagacucaaggugcccaacucaaggagaagcauaccucgacaaacaauccgacacccaauacgucuguaaacgaacacuugucgaccgcggaugggggaacggaugcggccucuucgggaaaggaucccucguaaccugcgccaaauucgcgugcucgaagaaaaugacgggaaaaagcauacagcccgaaaaccuugaauacagaauaaugcucagcguccacggaucacaacacagcggcaugauagucaacgacacaggccacgaaaccgaugaaaaccgggccaaaguagaaaucacgccaaacuccccacgagccgaagcgacacucggaggcuucggaucccuggggcuagacugcgaaccucgaacaggcuuggacuucagcgaccuguacuaccuaacaaugaacaacaaacacuggcugguacacaaagaaugguuccacgacaucccacuccccuggcacgccggagcagacaccggaaccccucacuggaacaacaaagaagcacucgucgaguucaaagacgcacacgccaaaagacaaacaguagugguccucgggagccaagaaggagcaguacacacagcccucgcaggcgcccucgaagcagagauggacggagcaaaaggacgccugagcucaggacaccuaaaaugcagacuaaaaauggacaaacuccgacuaaaaggcgucucuuacucacuauguacagcagcguuuaccuucacaaaaaucccagcggaaacauuacacggaaccgucaccgucgaaguacaauaugccggaaccgacggcccaugcaaaguccccgcacaaauggcagucgacaugcaaacacucacccccgucggacgccugaucacagcgaacccaguaaucaccgagucaacggagaacagcaaaaugaugcuagagcuggacccgccauuuggagauuccuacauagucaucggcgucggagagaagaaaaucacacaccacuggcaucgcagcggaagcacaauagguaaagcauucgaagcgacaguccguggagcaaaaaggauggcgguccucggcgauaccgcaugggacuucggcagcguaggcggagcccuaaacagccucggaaaaggcauacaccaaaucuucggcgccgccuucaaaagccuauucggcggaaugagcugguucagccaaauccuaauaggcacacuccucauguggcucggccucaacaccaaaaacggaagcaucagccucaugugccuagcccucggcggcguccuaaucuuccugucaacagccgugagcgcagacgucggcugcagcguggacuucucaaaaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9512 - RNA, 2365 nt, Artificial Sequence
  KY014320.1 prME-long mRNA Design 3 opt
gggagaaagcuuaccaugcgcauuaucaacgcgcgaaaagagaaaaagagacgaggcgcagacaccuccguaggcaucgucggccuacugcucaccaccgccauggcagcagaagucaccagaagagguucagcguauuacauguaccucgaccgaaacgacgcaggggaagcaaucagcuucccaaccacccuaggaaugaacaagugcuacauacaaaucauggaccugggacacaugugcgacgccaccaugucauacgaaugcccgaugcucgacgaaggaguagaacccgaugacgucgacugcuggugcaacaccaccagcaccuggguagucuacggaaccugccaccacaagaaaggcgaagcacgacgcucgcgcagagcagucacccucccaucacacucaacaagaaaacuacaggccagaucacaaacauggcucgaaucccgagaguauaccaaacaccugauccgcgucgaaaacuggauauuccgaaaucccggcuucgcacuggccgccgccgccauagccuggcugcucggcagcagcaccagccaaaaagugaucuaccucgucaugauacugcucauagccccagccuacucaauacgcugcauaggaguaucaaacagagacuucgucgaggggaugucaggaggcaccuggguagacgucguccucgaacacggcggaugcgugacagucauggcccaggacaaacccacaguagacaucgagcuagucacaacaacagucucaaacauggccgaaguucgcucauacuguuacgaagccagcaucagcgacauggcgagcgacucacgcugcccgacccaaggagaagccuaccuggacaaacaguccgacacgcaguacgucugcaagagaacccuaguagacaggggcuggggcaacggcugcgggcuauucgggaaagguagccuuguaaccugcgccaaauucgccugcuccaagaaaaugaccggcaaaucgauccagcccgaaaaucuagaauaccgcauaaugcucuccgugcacggcagccaacacucaggcaugauuguaaacgacacuggccacgagacggacgaaaaccgcgcaaaagucgaaaucacaccaaacuccccacgcgcggaggcaacccucggaggcuucggaagccuaggccucgacugugaaccccgcaccggccuagacuucucagaccuuuauuaccucacaaugaacaacaaacacuggcucguucacaaagaaugguuucacgacaucccgcuccccuggcacgcaggcgccgacacaggaacaccccacuggaacaacaaagaagcccuagucgaguucaaagacgcacacgcaaaacgccaaaccgucgucguacucggcucgcaagaaggagcaguacacaccgccuuggcaggcgcccucgaagccgaaauggacggcgccaagggccggcucagcuccggccaccucaaaugccgccuaaaaauggacaaacuacgacuaaaaggaguaagcuacagccuaugcaccgcugcauucacuuucacaaaaauacccgcagaaacccuacacggcaccgucacggucgaaguucaauacgccggcaccgacggacccugcaaagucccagcccaaauggcaguagacaugcagacacucaccccagucggaagacuaaucaccgcaaacccaguaauaacagaauccaccgaaaacagcaaaaugaugcucgaacucgacccgccguucggagacagcuacaucguaaucggcguaggcgaaaagaaaauaacacaccacuggcaccgauccggcuccaccaucggcaaggccuucgaagcaaccguacgaggagccaaacgaauggcaguacucggagauacggcuugggauuucggcagcgucgggggagcccuaaacucacuaggaaaaggcauccaucaaaucuucggagcggcuuuuaaaagucuauucggaggcaugaguugguucagccagauacuaaucggcacacuacuaauguggcucggccucaacaccaaaaacggauccaucucacuaaugugucucgcccuaggcggaguacuaauauuccucagcaccgccgucagcgccgacguaggaugcaguguggacuucucaaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9513 - RNA, 2365 nt, Artificial Sequence
  KX827309.1 prME-long mRNA Design 3 opt
gggagaaagcuuaccaugcgcaucaucaacgcgcgcaaggagaagaaacgccgaggcgcagacacauccgucggaaucguagggcuacuccucacaaccgcaauggccgcagaagugacacgacgcggaucugcauacuauauguaccuagacagaagcgacgcaggagaagcaauuagcuucccaacgacccucgggaugaacaaaugcuacauacaaauaauggaccucggacacaugugcgacgcaacgaugucuuacgaaugccccaugcuagacgaagggguggaacccgacgacgucgacugcuggugcaacaccacaagcacguggguagucuacggaaccugccaccacaagaaaggcgaagcccgcaggagcaggagagccguaacacuccccucccacagcacccgaaaacugcaaacgagaucacaaacguggcucgaauccagagaauauacaaaacaccuaaucagagucgagaacuggauauucagaaacccagguuucgcccuagcagcagcagcaauagccugguuacuaggaagcagcaccagccaaaaaguaauauaccuaguaaugauacuccucauagccccagcauacagcauacgguguaucggaguaagcaaccgagacuucgucgaaggaaugucgggaggaacauggguagacguaguacucgaacacggcggcugcguaacagucauggcccaagacaaaccaacaguagacauugagcuagugacuacaacagucagcaacauggcggaaguccgcucguacugcuacgaagcaucgaucagcgacauggcaagcgacaguagaugccccacacagggcgaagccuacuuagacaaacaaucagacacccaauacguauguaaaaggacccuagucgaucgcggauggggcaacggaugcgggcuauuuggcaaagguucacucguaaccugcgcgaaauucgcgugcaguaagaaaaugacaggcaaaaguauacaaccagaaaaccucgaguaccgcauaaugcuaucgguccacggcucccaacacagcggcaugaucgucaacgacacgggacacgaaaccgacgaaaacagagcaaaagucgagaucacaccaaacucaccacgagcagaggcaacccuuggcggauucggcagucucggacucgacugcgaaccgcggacaggccucgacuucucagaccuauauuaccuaaccaugaacaacaaacacuggcuaguacacaaagaaugguuccacgacauaccacuaccauggcacgccggcgccgacaccggcacaccacacuggaacaacaaagaagcacucguagaguucaaagacgcgcacgcgaaacgacaaacaguaguaguacuaggcucacaagaaggagcaguccacacagcacuggccggcgcacuagaagccgaaauggacggcgcaaaaggacgucuaaguagcggucaccuaaaaugccgacuaaaaauggauaaacuacgccuaaaaggggucucauacucgcucugcaccgcagcauucaccuuuacgaaaaucccagccgaaacccugcacgggacaguaaccguagaaguccaauacgccggcaccgacggcccaugcaaaguaccagcccaaauggccgucgacaugcaaacccugaccccggugggaagacugaucacagccaacccagucaucacagaaagcacggagaacagcaaaaugaugcuggaacuugacccacccuucggcgacagcuacaucguaauaggggugggagaaaagaaaauaacacaucacuggcaccgcucagguagcacaaucggcaaagcauucgaggcaacagucagaggagcaaaacggauggcaguccuaggagacacagccugggauuucggaagcguaggaggggcgcucaauucacuaggcaagggcauccaccaaauauucggagccgccuucaagucacuguucggcggaaugagcugguucagccaaauccucaucggcacacuauuaaugugguuaggacugaacacuaaaaacggauccaucagccucaugugccucgcgcugggcggcguacugauauuccugagcacagccguaagcgccgacgucgggugcucaguagacuuuucaaaaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9514 - RNA, 2365 nt, Artificial Sequence
  KU681081.3 prME-long mRNA Design 3 opt
gggagaaagcuuaccaugcgcauaauaaacgccagaaaagaaaagaagagaaggggaacagacacauccgugggcaucgucggccuccugcucacaacagccauggcagccgaagucacccgaagaggcagcgcauacuacauguaccuagacaggucagacgcaggcgaagcaauauccuucccaacaacacuaggaaugaacaaaugcuacauccagauaauggacuuaggacacaugugcgacgcaacgaugucauacgaaugccccauguuagacgaaggaguugaaccagacgacguggacugcuggugcaacacuacaucaacgugggugguguacggaacaugccaccacaagaaaggagaagcgcgcagauccagacgagcagugacccuaccaagccauagcacccgaaaacuccaaacaagaagccaaaccuggcuggagagcagggaauauaccaaacaccucauaagggucgagaacuggauauucagaaacccaggcuucgcacucgccgcagcagccauagccuggcuccuaggcucaagcacaagccaaaaaguaauauaucucgugaugauccuacuaaucgcaccagcauacucaauacgcugcaucggcgucaguaacagggacuucguagaagggaugucgggaggcacauggguggacguuguacucgagcacggaggaugcgucaccgucauggcacaagauaaacccacaguggacaucgaacucguaacuaccacagugucuaacauggcagaaguacgaucauacugcuacgaagcgucgauaucagacauggccagugacucccggugcccgacacaaggagaagcauaccucgacaaacagagcgacacacaauacguauguaaaagaacgcugguagaccgcggauggggcaacggcugcggacucuucggcaaaggaucccucguaaccugcgcaaaauucgcgugcucaaagaaaaugaccggaaagagcauacaaccagaaaaccucgaguaccgcauaaugcucucaguccacggaagccagcacagcgggaugauagucaacgacacaggccacgaaacagacgaaaaucgagcaaagguagaaaucacaccgaacagcccccgcgccgaagccacgcuaggaggauucggcucccuaggacucgacugugaaccgcgcacaggacuagacuucuccgaccuauacuaccucacaaugaacaacaaacacuggcuagugcacaaggaaugguuccaugacauaccccuccccuggcacaccggagccgacaccggaacaccacacuggaacaacaaagaagcccugguagaguucaaagacgcacacgcaaaaagacaaacaguagugguccuaggcagucaagaaggcgcuguacacacagcacuagcaggagcacuagaagccgaaauggacggcgcaaaaggaagacugucgucaggacaccucaagugccgauuaaaaauggacaaacuaagacugaaaggagucucguacagccucuguaccgcggccuucacauucaccaagauaccagccgaaacacugcacggaacaguaacaguagaagugcaguacgccgggacggacggaccaugcaaagugccagcacaaauggccguagacaugcaaacacucacgccagucggccgccugaucaccgccaaccccgucauaacagaagggaccgagaacucgaaaaugaugcuggaguuggacccacccuucggagacagcuacaucguaaucggagugggcgagaaaaagauaacgcaccacuggcaccgcaguggaagcaccaucggcaaagccuucgaagccaccguccgcggcgcaaagagaauggcaguccuaggcgacacagcaugggacuucggaagcguaggaggcguucugaacagccuaggcaaaggaauccaccaaaucuucggcgcagccuucaaaucacucuucgggggcaugucaugguucagccaaauacuaauaggcacccuacucauguggcucgggcuaaacacuaaaaacggaagcaucagccuaaugugccucgcccugggaggcguacuaaucuuccuaagcacagcaguuucagccgacgugggaugcagcgucgacuucucaaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9515 - RNA, 2365 nt, Artificial Sequence
  KU744693.1 prME-long mRNA Design 3 opt
gggagaaagcuuaccaugcgaauaauuaacgcuagaaaagaaaagaaaagacgaggagccgauacauccguagggauugucggacuacuccuaacaacagcgauggcggcagaagugacacggcguggcagcgccuacuacauguaccuggaccgaaacgacgcaggcgaagccaucucauucccaacaacacuuggcaugaauaaaugcuacauccaaauaauggaucuaggccacaugugcgacgcgacaaugagcuacgaaugcccaaugcuagacgaaggcgucgaacccgacgacguggacugcuggugcaacaccaccuccaccugggucguguacgggaccugccaccacaagaaaggagaagcccgacgcucaagacgcgcgguaacacuaccaucacacucaacccgaaaacugcaaacccgcagucagaccuggcucgagucgcgagaauacacaaaacaccugauacgaguagaaaauuggaucuuccgaaacccgggauucgcccucgccgccgccgcaaucgccuggcuccuaggauccuccacaagccaaaaagucaucuaccucguaaugauccuccuaaucgcaccagccuacagcauaagaugcauaggaguaagcaauagagacuucgucgaaggaaugucaggcggcacauggguagacgucguacuagagcacggaggaugcgucaccgcaauggcccaagacaaaccaacaguagacaucgaauuagucacaacaacaguguccaacauggcagaaguacgcucauacugcuacgaagccagcaucagcgacauggcgagcgacucccggugccccacgcaaggcgaagccuaucucgacaaacagucagacacccaauacgucugcaaacgaacuuuaguugaccgcggcuggggcaacggaugcggccucuucggcaaaggaucacucgucacgugcgcgaaauucgccugcagcaagaaaaugacagggaaaucaauucagccugaaaaccuagaauaccgcaucauguuaagcguccacggaucacagcacuccggcaugcucgugaaugauacaggccacgaaaccgacgaaaauagagcgaaagucgaaaucaccccgaacucuccacgggcagaagcaacacuaggcggcuucggcucccucggacucgauugcgagccccgcaccggacucgacuuuagugaccucuacuaccucacaaugaacaacaaacacuggcucgcacacaaagaaugguuccacgacaucccgcuacccuggcacgccggagcagccaccggcacaccccauuggaauaacaaagaagcacucgucgaguucaaagacgcacacgcgaaacgccaaacagucguagucuuaggaagucaggaaggcgccguccacaccgcucucgccggcgcccucgaagccgaaauggacggcgccaaaggccgacucuccagcgggcaccuaaaaugccgacucaaaauggacaaacucagacucaaaggcguaucauacagccucugcacagcagcauucaccuucacaaaaauccccgcugaaaccguugacggcacaguaaccguagaaggccaauacgggggcaccgacggccccugcaaaguccccgcgcaaauggcgguagacaugcaaacccucacgcccguaggccgccucauaacagccaaccccgugaucacagaaucaacggaaaacagcaaaaugaugcuagaacuggaucccccauucggagacucauacauagugaucggugucggagaaaagaaaaucacccaccacuggcaccgcucaggcucaacaauuggaaaagccuucgaagcaacagucagaggcgcaaaacgcauggccguccugggagacacagccugggacuucggcucagugggcggcgcccucaacucccucgggaaaggcauccaccagaucaucggagcggccuucaaaagccuauucggcggaaugucaugguucagccaaauacuaauaggaacacuacuaauguggcuaggacucaacaccaaaaacggcaguaucucacucaugugccuagcccucggcggagucuuaaucuuccucucaacagcuguaucaggcgggguaggcugcuccguagacuucuccaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9516 - RNA, 2365 nt, Artificial Sequence
  KY328290.1 prME-long mRNA Design 3 opt
gggagaaagcuuaccaugcgaaucauaaacgcacgcaaagaaaagaaacgacgagggacggacaccuccgucggaaucguaggccuccuucugaccaccgcaauggccgccgaagucacccgccgaggcucugcauacuacauguaccucgaccgcagcgaugccggagaagcgaucucauuccccacaacacucggcaugaacaaaugcuacauucaaaucauggaccucggacacaugugcgacgccacaauguccuacgaaugccccaugcuagaugaaggcgucgaaccagacgaugucgacugcuggugcaauacaaccagcaccugggucguguacggcacaugccaccacaagaaaggggaagccagacgcagccgacgagcagucacacuaccgucacacagcacacguaaacuccaaacccgcagccaaacauggcuggaguccagagaguacaccaaacaccugauaaggguagaaaacuggauauuccgcaacccuggcuucgcccucgccgccgcagcaaucgccuggcuacucggcucaucgaccucccaaaaaguaaucuaccucgucaugauacuucucaucgcccccgcauacuccauccgaugcauaggaguguccaaccgcgacuucguggaaggcauguccggcggaaccugggucgacguaguacuagaacacggaggaugcguaacggucauggcacaagacaaacccacaguugauauagagcucguaaccaccaccgucagcaacauggccgaaguacgcucauacugcuacgaagccuccaucucggacauggcuagcgauucccgcugccccacacaaggagaagcguaccuggacaaacaaucggacacacaauacguaugcaaacggacccuagucgaccgcgguuggggcaacggcugcggacuuuucggaaaaggaagccucguaacaugcgccaaauucgcaugcucgaaaaagaugaccggcaaaagcauacaaccagagaaccucgaguacagaauaaugcucucaguccacggcucccagcacuccggcaugauugugaaugacacgggccacgaaaccgacgagaaucgcgcuaaggucgaaaucacacccaauucaccacgcgcggaggccacacucggcggguuuggaagccucggccucgacugcgaacccagaacaggacuagacuucagcgaccuguacuaccucaccaugaacaauaaacacuggcuaguccacaaagaaugguuccacgacauccccuuaccauggcaugcaggcgccgacaccggcacaccccacuggaacaacaaagaagcccucguagaguucaaagacgcacacgccaaacgacaaacaguagugguacugggaucucaggaaggagccguacacacagcccuagcaggcgcauuagaagccgaaauggacggagccaaaggucgccucucuagcggacaucucaagugccgccugaaaauggacaaacucagacuaaagggagucucuuacucauuaugcaccgcagccuucacauuuuccaagaucccagccgaaacacugcacggcaccgucaccgaggaaguacaguacgccggaaccgacggcccaugcaagguaccagcccaaauggcggucgacaugcaaacacuaacccccgucggccgacucauuacagcuaaccccguuaucacagaaucaaccgaaaacucgaaaaugaugcuagaacuagacccacccuucggagacuccuacaucgucaucggcguaggcgaaaagaaaauuacacaccacuggcaccgcaguggcagcacgauaggaaaagcauucgaagcaacuguccgcggagccaaacgcauggcaguccucggggacaccgcaugggacuucggaagcgucggaggcgcccucaacucgcucggaaaaggaauccaccaaauuuucggagcagcguucaagucccuguucgggggcaugagcugguucagccaaauacucauaggaacacuacucaugugguuaggcuuaaacacuaagaauggcagcaucagccucaugugccucgcccuaggcggaguacucaucuuccucagcacagccgugagcgccgacguaggcugcagcgucgacuucucaaaaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9517 - RNA, 2365 nt, Artificial Sequence
  KX694532.2 prME-long mRNA Design 3 opt
gggagaaagcuuaccaugcgcauaaucaacgcccggaaagaaaagaaacgacgaggcacugacaccuccgucggaauagucggacuacuacuaacuacagccauggccgcagaagucacaaggcgcggaucagcauacuacauguaccuagaccgcucagacgccggcgaagccaucagcuucccaaccacacuaggaaugaacaaaugcuacauacagauaauggaccugggacacaugugcgacgccacaaugagcuacgaaugcccaaugcuagacgaaggcguugaacccgacgacguagacugcugguguaacacgaccagcaccugggucguauacggaacaugccaccacaagaaaggcgaagcuaggcgcucccgacgcgccgucacccuaccgagccauuccaccagaaaacuccaaacgaggucccagaccuggcuggaaucccgagaauacacaaaacaccuuauacgaguagaaaacuggauauuccgaaacccgggguucgcccuggccgccgcugccauagccuggcuccucggcuccuccacaagccaaaaaguaauauaccugguaaugauccuacuaauagcccccgccuacagcaucaggugcaucggcgucucaaacagagacuucgucgaaggcauguccggcggaaccuggguggacguaguccuggagcauggcggaugcgugacaguaauggcccaagacaagccaaccguagacaucgaacugguaacuacaaccgucagcaacauggccgaaguccgaagcuacugcuacgaagccagcauaagcgacauggccuccgacucccggugcccaacacaaggcgaagccuaccuagacaaacaauccgacacgcaauacguaugcaaacgaacccuagucgacagaggauggggcaacggcugcggccucuucggcaaaggaucacucgucacgugcgccaaguucgccugcaguaagaaaaugacaggcaaaucgauacaacccgaaaaccuagaauaccgcaucaugcuaagcguacacggcagccaacacucaggaaugaucgugaacgacacaggccacgaaacagacgaaaaucgagcaaaaguagaaaucaccccuaacagcccacgugccgaagcaacacuaggaggauucggcagccuaggccuugacugugagccacgaaccggacucgacuucuccgaccuguacuaccucacgaugaauaacaaacauugguuaguccacaaagaaugguuccacgacauaccauugccauggcacgcaggcgcggauaccggaacgccacacuggaacaacaaagaagcacucgucgaguucaaagaugcacacgcaaaaagacagaccguagucguacuuggcagucaagaaggcgccguccacaccgcgcuugccggagcccuagaagccgaaauggacggcgccaaaggccgacucuccuccggacaccucaaaugccgacugaaaauggacaaacuccgacucaaaggcguaagcuacagcuugugcaccgccgccuucacauucacaaaaauaccagcagaaacucuccacggcaccguaaccguagaaguacaguacgccgggacagacggccccugcaagguaccagcacaaauggccgucgacaugcaaacccuaacacccguuggcagacuaaucacagcgaacccaguaaucaccgaaagcaccgaaaauagcaagaugaugcucgaacucgaucccccauucggcgacagcuacauagucauaggagucggcgagaagaaaaucacccaccacuggcaccgaagcggcagcaccauaggaaaagccuucgaagccacagugagaggcgcgaaaagaauggcaguccucggcgacacagcgugggacuucggcagcgucggcggcgcacucaacucacucggcaaaggcauccaccaaaucuucggcgcagccuucaaaagccucuucggcggcauguccugguucagccaaauacuaaucgggacccuacugauguggcuaggacuaaacaccaaaaacggaucgaucucccucaugugcuuagcacucggcggcguccuaauauucuuaagcaccgccguauccgcagacgugggcugcagugucgacuucucaaaaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9518 - RNA, 2365 nt, Artificial Sequence
  KU955593.1 prME-long mRNA Design 3 opt
gggagaaagcuuaccaugcgaauaaucaacgcacgcaaagagaaaaagagaagaggaacagacacaucagucggcaucgucggauuacugcucacgacggcaauggcgguagaggugacccgcaggggaaacgccuacuacauguaccuagacagaagcgacgcaggagaggcuaucuccuucccgaccacaaugggcaugaacaaaugcuacauccaaaucauggaccuagggcauaugugcgacgcaaccaugagcuacgaaugcccaauguuagacgagggagucgaaccagacgacguugacuguuggugcaauaccacaagcaccugggucguauacggcacaugccaccacaagaaaggggaagcgaggcgcagucgacgcgccgucacccuacccagccauuccacacgcaaguuacaaacgcgcagccaaacguggcuagaaagccgagaauacaccaaacacuuaaucagagucgaaaacuggaucuucagaaacccgggauucgcacuagcagccgccgcgaucgccuggcuacuagguucgagcacaagccaaaaagucaucuaccuagugaugauacuccuaauagcccccgcauacagcauacgguguauaggcguaucaaacagagauuucgucgagggaauguccggcggaacauggguagacguaguacuggaacacggcggaugcguaacagucauggcacaggacaaacccacagucgacauagaacucgucaccaccaccgucagcaacauggccgaaguacgcagcuacugcuacgaggcaucaauauccgacauggcauccgacagcagaugcccaacgcagggagaggccuaccuagacaaacaauccgacacacaguacgugugcaaaagaacccuaguagaccgagguuggggcaacggcugcggacuauucgggaaaggcucgcuaguaaccugcgccaaauucgccugcagcaagaaaaugaccggcaaaucaauucaaccagaaaaccucgaauaccgaaucaugcucagcguccacggaagccaacacagcggaaugauaguaaacgacaccggccacgaaacagacgagaacagagcgaaagucgaaauaacacccaacaguccccgcgcagaagccacccugggaggauucggcagccucggccuagacugcgaaccacgaacaggacuagacuucagcgaccuguacuaccugacaaugaacaacaaacauuggcuaguacacaaagaaugguuccacgacauaccacucccuuggcacgcuggcgccgacacaggaacaccccacuggaacaacaaagaagcccuagucgaguucaaagaugcacacgcaaaacgccaaaccguagugguccugggcucacaggaaggagccgugcacacagccuuagcgggcgcgcucgaagccgaaauggacggagccaaaggcagauuaagcagcggacaccucaaaugccggcugaaaauggacaaacugcgacucaaaggaguauccuacagccucuguacagcggccuuuacauucacaaaaauaccagcggaaacgcuucacgggacaguaacaguugaaguacaauacgcuggaacagacggacccugcaaaguaccggcacagauggccgucgacaugcaaacccuaaccccaguaggacgccugauaacggccaacccagugaucaccgaaagcaccgaaaacucaaaaaugaugcucgaacucgacccgccauucggcgacagcuacauagucauaggagugggagaaaagaaaauaacgcaccacuggcaccgcagcggcaguacaaucggaaaagccuucgaagcaaccgugcgcggcgcaaaaagaauggccguacuaggagacaccgcuugggacuucggcagcguaggcggagcccucaacagccucgggaaggggauccaccaaaucuucggagcagccuucaagagccuuuucggaggcauguccugguucagccagauacuaauagggacccuacugguauggcuaggucucaacaccaaaaacggcagcauaagucuuaugugccucgcacuaggcggaguacuaauauuccuaagcacagcagugagugccgacguaggcugcagcguagacuucuccaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9519 - RNA, 2365 nt, Artificial Sequence
  KY272987.1 prME-long mRNA Design 3 opt
gggagaaagcuuaccaugcgaaucauaaacgcccgcaaagaaaagaaaaggagaggcacagacacaagcguaggaaucguggggcuccugcuaacaacagccauggcggccgaggucacccguagaggcagcgcguacuacauguaccuagaccgcagcgacgccggagaggccaucagcuucccgacaacccuaggcaugaacaaaugcuacauacaaauaauggaccucggccacaugugcgacgcgaccaugucauacgaaugcccaaugcuggacgaaggagucgaacccgacgacguagacugcuggugcaacacaacgagcacguggguagucuacggaaccugccaccacaagaaaggcgaagcacgacgaucccgacgagcggucacgcucccaagccacuccacccgaaaacuccagaccagaagccaaaccuggcuagaauccagggaauacaccaaacaccucauccgcguagaaaacuggauauuccgaaaccccggcuucgcacucgcagcagcagccauagcauggcuacucggcagcagcacaagccaaaaaguaauauaccuggugaugauacuacugaucgcccccgccuacagcauccgcugcauuggagucaguaacagagacuucguagagggcaugaguggaggaacauggguggacgucguccuggaacacggaggaugcgucacaguaauggcacaagacaaacccacagucgacaucgaacucguuacaacgaccgucucaaacauggccgaaguacgcagcuacugcuacgaggcaaguauaagcgacauggcaagcgacagccgaugcccgacccaaggagaagcauaccuggauaaacaaagcgacacgcaauacgucugcaaaagaacccuagucgaccgcggaugggggaacggaugcggacuauucggaaaagggagccucguaacaugcgcaaaauucgcgugcucaaagaaaaugacaggcaaaagcauccaaccagaaaaccuagaauaccgaaucaugcuaagcguacacggaucccaacacagcggaaugauagucaaugacacgggacaugaaacagacgaaaacagagccaaagucgaaauaacaccaaacaguccccgcgcggaagccacccucgggggauucggaagccucggcuuagacugcgagccgcgcacaggacuagacuucagcgaccuauacuacuuaaccaugaauaacaaacauuggcucguccacaaagagugguuccacgacaucccacuuccguggcacgccggcgcggacacaggcacaccgcacuggaacaacaaagaagcccucguggaguucaaagacgcccacgccaaacgacaaacagucguaguucuagggucccaagaaggcgcaguacacaccgcacucgcaggcgcccucgaggccgaaauggacggcgccaaaggccgacuguccagcggacaccucaagugcagacuaaaaauggacaagcuccgccuaaaaggcguaucauacucgcuauguacagcggcauucacauucaccaaaaucccagccgaaacccuccacggaaccguaacaguagaaguacaauacgcaggaacagacggcccgugcaaaguaccggcccaaauggcaguagacaugcaaacacucacacccgucggaaggcuaaucacagcaaacccagucauaacggaaagcacagaaaacagcaaaaugaugcucgaacuagacccaccguucggcgacagcuacauaguuauagggguaggagaaaagaaaauaacacaccauuggcauagauccggcagcacaaucgggaaagcauucgaagcgacagucagaggagcuaaacgaauggccguacucggcgacacagccugggacuucggauccgugggcggggcccugaacagucucggcaaaggaauccaccaaaucuucggagccgcauucaaaucgcuauucggcggcauguccugguucucccagauccuaaucggaacccuauuaauguggcucgggcuaaacaccaaaaacggauccauuucccugguaugccucgcccucggaggaguacucauauuccugagcacagccgucagcgccgauguaggaugcuccguggacuucagcaaaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9520 - RNA, 2365 nt, Artificial Sequence
  EU545988.1 prME-long mRNA Design 3 opt
gggagaaagcuuaccaugcgcauaaucaacgcaagaaaagaaaagaaacgccgaggcacagacaccagcgugggcauagucggacuacuccuaacaaccgccauggccguugaagucacacgacgaggaagcgcauacuacauguaccuagaccguagcgacgccggagaagcaauauccuucccaaccacccuaggaaugaacaaaugcuacauccaaauaauggaccuaggccauaugugcgacgcuacgaugaguuacgaaugccccaugcuggacgaaggcguagagccggacgacgucgacugcuggugcaacaccaccagcaccuggguagucuacggaaccugccaccacaagaaaggcgaggcacgcagaagccgccgagcagucacccuaccaucccacucaacacgcaaacuacaaacaagaucccaaaccuggcuggaaagccgcgaauacacaaaacaccugauacgagucgagaacuggaucuuccgaaacccaggcuucgcccucgccgcagccgccaucgcguggcuacucggcagcuccacuagccaaaaagugauauacuuaguaaugauacuccucaucgccccagccuacucgauccgcugcaucggcgucagcaauagggauuuuguagaaggcaugagcggcgguacuugggucgacgucgugcuagagcacggcggcugcgucacaguaauggcacaagacaaacccgccgucgacaucgaacucguaacgacgacaguaucaaacauggccgaagucagaucguauugcuacgaagccuccaucagcgacauggccagcgacucccgcugcccaacacagggagaagcauacuuagacaaacaaagcgacacacaauacguaugcaaacgaacccuagucgaccgcggaugggggaacgggugcggucuauucggaaaaggaucacucguaaccugcgccaaauucgcgugcagcaagaaaaugaccggcaaaucgauacaaccagaaaaccucgaauacagaaucaugcuauccguccacggcucccaacacucuggcaugaucguaaacgauaccggccacgaaaccgacgaaaaccgagccaaaguggaaaucaccccgaacagcccucgggcagaagccacgcugggcggguucgggagccuaggacucgacugugaaccacgcaccggacuagauuucagcgaccuauacuaccugaccaugaacaacaaacacugguuaguccacaaagaaugguuccacgacauaccacucccauggcacgcaggcgccgacacaggcaccccacacuggaacaacaaagaagcacugguagaguucaaagacgcccacgccaaacgccaaacggucguagugcuagggucacaggaaggcgcgguccacaccgcccucgccggcgcccuggaagcagaaauggacggugccaaaggacgccucagcucaggacaccuaaaaugccgacucaaaauggacaaacugcgccucaaaggggucucauacucacuaugcaccgccgccuucaccuucaccaaaaucccagccgaaacacuccacggaacaguaaccguggaaguccaguacgccggcaccgacggacccugcaaggugccagcacaaauggccguagacaugcaaacccucaccccagucggacgccuaauaacugccaaccccgucaucaccgaaagcacagaaaacucaaaaaugaugcuugaacuggaucccccauuuggcgacagcuacaucgucaucgggguuggcgaaaagaaaaucacacaccacuggcaucgcucaggcuccaccaucggcaaagcguucgaagccaccguccgcggcgcaaaacgcauggccguacugggagacaccgcaugggacuuuggaagugucggaggcgcccugaacucacuagggaaaggaauacaccaaaucuucggagcagcguucaaaagccucuucggcggaaugaguugguucagccaaauccuuauaggaacccuccucguauggcucggguuaaacaccaaaaacgggagcauuagccuuacaugccuagcccucggcggcguacucauauuccucagcaccgcugucucggccgacgucggcuguuccguagacuucagcaaaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9521 - RNA, 2365 nt, Artificial Sequence
  KU681082.3 prME-long mRNA Design 3 opt
gggagaaagcuuaccaugcggaucaucaacgccagaaaagaaaagaaacggcgcggagcggacacaucagucgggaucguaggccuacuucucaccacggcaauggcagucgaaguaacaagacgcggaagcgccuacuauauguaccucgaccgcuccgacgccggagaagcaaucagcuuccccacuacccuaggcaugaacaaaugcuacauccaaaucauggaccucggacacaugugugacgccacgaugucauacgaaugccccaugcucgacgaaggaguggaacccgacgacguagacugcuggugcaacaccacaucaacauggguugucuacggaaccugccaccacaagaaaggagaagcccgucgaagccggcgagccguaacacucccuucgcacucaacccgaaaacugcaaacaagaucccaaacauggcuagaaagucgugaauacacaaaacaucuaauacguguggagaacuggaucuuccgaaaccccggauucgcauuagcagccgccgucauagccuggcugcuaggaagcagcaccagccaaaaaguaauauaccuggucaugauccuacucauagcgccagccuacuccaucagauguauaggcgucucaaaccgggacuucgucgagggaauguccggaggcacuugggucgacgugguacuggaacacggcggaugcgucacagucauggcacaagacaaaccaacuguagacauagaacucgucacgaccacggucagcaacauggccgaggucagaagcuacugcuacgaagccagcauuucagacauggcaagcgacagccggugcccgacccaaggagaagcguaccuagacaagcaaagcgacacccaauacgucugcaaaagaacccucgucgaccggggcuggggcaacggcugcggacucuucggcaaaggaagucuaguaacuugcgcaaaauuugcgugcucgaagaaaaugaccggcaaaucaauccaacccgagaaccuagaguacagaauaaugcuaucaguucacggcagucagcacuccggaaugaucguaaacgacaccggccacgaaaccgacgaaaaccgcgcaaaagucgaaauaacacccaacagcccccgagccgaagccacacucggaggguucggcucccuaggacuagacugcgagccacgcaccggacucgacuucucagaccuauacuaccuaaccaugaacaacaaacacuggcucguccacaaagaaugguuccacgacauaccgcuccccuggcacgccggagcggacaccggcacaccccacuggaacaacaaagaagcccuagucgaguucaaagacgcacaugcaaaacgccaaaccguagucguacucggcagccaggaaggggccgugcacacagcccuagcaggagcccucgaagccgaaauggacggagccaaaggacgacucucaagcggccaccucaaaugccgacuaaaaauggacaaacuacgacuaaaaggcgucagcuauagccugugcaccgcagccuuuaccuuuacuaagauucccgcggaaacccuacauggcaccgucaccguagagguacaauacgccggcaccgacggcccaugcaaaguccccgcccaaauggccgucgacaugcaaacgcucacaccagucggaagacuaauaacagccaaccccgucaucaccgaaaguaccgaaaacaguaaaaugaugcuagaacucgauccacccuucggagacucauacaucgucaucggagucggcgaaaagaaaauaacacaccauuggcauaggucgggcuccacaauaggaaaagcauucgaagccaccguccgcggugcaaaacgaauggcaguccuaggggacacagcaugggacuucggcagcgucggaggugcacuaaacucccucggcaaaggcauccaccaaaucuucggcgcagccuucaaaucccuguucggaggcauguccugguucagccaaauccucaucggcacccuauuaguauggcuaggccucaacacgaaaaauggcucgauaucacuaacaugucucgcccuaggcggaguccucaucuuccuaagcaccgccguauccgcagacgucggaugcuccguagacuucucaaaaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9522 - RNA, 2365 nt, Artificial Sequence
  KX601167.1 prME-long mRNA Design 3 opt
gggagaaagcuuaccaugcgaauuauaaacgcccgcaaagagaagaaaagacgcggagccgacacauccguggguaucgucggacuccuccuaaccaccgccauggccgucgaaguaacccgacgcggauccgcguacuacauguaccuugaccgcucagacgcgggggaagccauaucuuuucccaccacacuaggagucaacaaaugcuacauccaaaucauggaccuaggccacaugugcgacgccacaaugagcuacgagugccccaugcucgacgaagggguugaaccagacgacguugacugcuggugcaacaccacguccaccuggguugucuauggaaccugccaccacaagaaaggcgaagcccgccggucccgccgagccgucacccugcccagccacagcacacgcaaacuacaaacccgaucucaaacauggcuagagucacgagaauauacaaaacaccucauccgagucgaaaauuggaucuuccgcaacccaggcuucgcgcucgccgcagccgccaucgcauggcuccucggauccucaaccucacaaaaaguuauauaccugguaaugauauuacucauagcaccagccuacucaauacgaugcauaggagucuccaaccgcgacuucgucgagggcaugagcggaggcaccuggguagacgucguccuagaacacggaggcuguguuaccgucauggcgcaagacaaacccacagucgacaucgaacucguaacaaccaccgucuccaauauggcggagguacgaucauauuguuacgaagcaucaauaucagacauggcgagcgacagucgcugcccgacccaaggcgaagccuaucuugacaaacaaagcgacacacaguacguaugcaaacgaacacucguagaccgaggcuggggcaacggcuguggccuguuuggcaaagguagccugguaacaugcgcaaaauucgccugcuccaagaaaaugaccggcaaaucaauacaacccgaaaaccuagaauaccgcaucaugcuguccguccacggcagccaacacagcggcaugaucgucaacgacaccggacacgaaaccgacgaaaaccgcgccaaaguagagauaacaccuaacucaccccgagccgaagccacacucggaggcuuuggcagccuaggacucgacugcgaaccccgaacaggacucgacuucuccgaccuauauuaccuaacaaugaacaacaaacacuggcuaguacacaaagaaugguuccacgacauaccacuacccuggcacgccggagccgacaccggaacaccccacuggaacaacaaagaagcacucgucgaguucaaggacgcacacgccaaacggcagaccgucguuguccuaggcucacaagaaggcgcgguccacaccgcucucgcaggcgcccucgaagcagaaauggacggcgccaaggggaggcucuccuccggacaccucaagugccgccuaaaaauggacaaacuacggcucaaaggaguaagcuacagccucugcacagcagcauucacauucaccaaaauaccagcagaaacgcuacauggaacagucacggucgaaguacaauacgcgggcacagacggacccugcaaagugcccgcacaaauggcgguugacaugcaaacccuuacgccagucggccgacucaucaccgccaaccccgucauuacagaauccacagaaaacuccaaaaugaugcuugaacuggacccacccuucggcgacucguacauaguaauaggcgucggcgacaagaaaaucacccaccacugguaccgcuccggcucaacaaucggaaaagcauucgaagcaaccguccgaggugccaaacguauggcaguacuaggcgacaccgccugggacuucggcuccguaggaggagcacucaacucccucggaaaaggaauccaucaaauauucggagccgccuucaagucccuauucggcggcaugucaugguuuagccagauccucauaggaacccugcuaguauggcuaggccucaacaccaaaaacgggucaaucucuuuaaccugccuagcauuagggggaguucucauauuccucagcacagcaguaagcgccgacguaggcuguuccgucgauuucucaaaaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9523 - RNA, 2365 nt, Artificial Sequence
  KX694533.2 prME-long mRNA Design 3 opt
gggagaaagcuuaccaugcgcauaaucaacgcacgcaaagaaaagaaaagacgcggagcagacacaagcgugggaauuguaggccugcuauuaaccacugccauggcgguagaaguaacacgacgcggaucagcauacuacauguaccuggacagaagcgacgcuggcaaagccaucuccuucccaacaacgcugggaguaaacaaaugcuacauccaaauaauggaccuagggcacaugugcgacgccacaaugagcuacgaaugcccgaugcucgacgagggaguagaaccagacgacgucgacugcuggugcaacacaacuagcacauggguaguauacggcaccugucaccacaagaaaggagaagcacgccggagccgacgggcagucacgcuacccucacacagcacacgaaaacuacaaacucgcucccaaaccuggcucgaaagccgagaauacaccaaacaccuaauccgcgucgagaacuggaucuuccgcaacccaggauucgcacuagcagcugcagcaaucgcguggcugcucggaagcagcacaagccaaaaaguaauauaccuaguaaugauacuccucaucgcccccgccuauaguauacggugcaucggcgucagcaaccgagacuucgucgaaggcaugagcggcggcacgugggucgacgucguccucgaacauggcggaugcgucacaguaauggcccaggacaaaccaaccgucgacaucgaacuugucacaacgaccgugagcaacauggccgaaguccgcuccuacugcuaugaagccuccaucucagauauggccucagacagccgaugcccaacccagggcgaggcauacuuggacaaacaaagcgacacccaauacgucugcaagcgaacacuggucgaccgagggugggguaauggaugcggccuauucggcaagggaagccuagucaccugugcaaaguucgccugcucaaagaaaaugacagggaaauccauccaacccgaaaaccucgaguaccgcauaauguugagcguccacggcucccaacacagcggcaugauaguaaacgacaucggccaugaaaccgacgaaaaucgagcaaaaguagaaauaacaccuaacaguccgagagcggaagcaacacuaggaggcuucggcucgcuaggccuagacugcgaaccccgaaccggacucgacuucagcgaccuauacuaucucacuaugaacaacaaacacuggcucgugcacaaagagugguuccacgacaucccgcuccccuggcacgcaggagccgacacaggcaccccacacuggaacaacaaagaagcgcuagucgaguucaaagacgcacacgcuaaaagacaaaccguggucguccuaggcucacaagaaggcgcaguacacacagcacuagccggcgcucucgaagcagaaauggacggagccaaaggucgacuauccuccggccaccuaaaaugccgccucaaaauggauaaacuccgccucaaaggcguaucauacagucuaugcaccgccgcauucacauucacaaaaauaccagccgaaacccuccacggcaccguaaccguagaaguacaguacgcaggaaccgacggaccaugcaaagugccagcccaaauggcagucgacaugcaaacacucacuccagucggacgacuaaucaccgcuaaccccgucauaaccgagagcacggaaaauuccaagaugaugcuagaacuggaucccccguucggcgacagcuacauagucaucggagucggagacaagaaaaucacacaccacuggcaccgaagcggcagcaccaucggaaaagcguucgaagcaaccgucagaggcgccaaacgaauggccguacucggagacacggccugggacuucggcuccgucggcggagcacucaauucccucggaaaagguauccaccaaauuuucggcgccgcauucaaaucacuauuugggggcauguccugguucucgcagauacuuaucggcacccuccuaguauggcuaggacuaaacaccaaaaacggcagcauaagccucacaugccuagcccucggagggguccuaauauuccugagcacagccguaagcgcugacgucggcugcagcgucgacuucagcaaaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9524 - RNA, 2365 nt, Artificial Sequence
  KY288905.1 prME-long mRNA Design 3 opt
gggagaaagcuuaccaugagaaucaucaacgcaagaaaagaaagaaaaagaagaggcgccgacacaucaaucggcaucgucggccugcuacuaacaacagcuauggcagcagaaaucacccgacgaggcucagcguacuacauguaccucgacagaagcgacgccggaaaagcuaucagcuucgccacgacacugggagucaacaagugccacgugcagauaauggaucucggacacaugugcgacgcaaccaugaguuaugagugccccaugcuagacgaaggcguagagccagacgacguagacugcuggugcaacacaacaagcaccuggguaguauacggcacaugccaccacaagaaaggagaagcaagacgaagcaggcgcgcaguaacacuacccucacacagcacacgaaaacuccaaaccagaagccagacauggcucgagagccgugaauacacaaaacaccuaauaaaaguggaaaacuggauauuccgcaacccaggguucacccuaguagccguagcaaucgcguggcuucucgggagcagcaccucccagaaagucauauaccucguaaugauccuucucauagcuccggccuacagcauacgaugcauaggcguaagcaaccgcgacuucgucgaaggaaugucagggggaacauggguggacguaguacuagaacacggaggcugcgucacgguaauggcacaagacaaaccaaccgucgauaucgagcuagucaccaccacagucagcaacauggcggaaguacgaagcuacugcuacgaagccucaaucagcgacauggcgagcgacucucgcugcccaacacaaggcgaagcauaccucgauaaacaaagcgacacgcaguacgucugcaaacgcacccucgucgacagaggguggggcaacggguguggccuauuuggaaagggaucauuagucacaugcgcaaaauucacaugcagcaagaaaaugacagggaaaagcauccaaccugagaaccucgaauaccgcauaaugcucagcguccauggaucacaacacuccggcaugaucgucaacgacacgggacacgaaacagaugaaaaucgagcgaaaguagaggucacaccgaauagccccagagccgaagccacacuaggaggauucggaagccucggccuggacugcgaaccgcgaaccggccucgacuucagcgaccuauacuaccucaccaugaacaacaaacauuggcuaguccacaaagaaugguuccacgacaucccccuccccuggcacgcaggcgccgacacgggaaccccucacuggaacaacaaagaagcacugguugaguucaaagacgcacacgccaaaagacaaacaguaguaguauuagggagccaggaaggagccguacacacagcccucgcaggcgcccuagaagccgaaauggacggagccaaaggcagacuguucagugggcaccucaaaugcaggcuaaaaauggacaaacuacgccuaaaaggcguaagcuacagccuaugcacagccgcauucaccuucacaaagguccccgcggaaacacugcaugggacgguaacaguagaagugcaauacgcaggcacagauggacccugcaaaguaccagcacaaauggccguagacaugcaaacacuaacacccgucggaagacucaucaccgcaaacccagucaucacggaaucaacagaaaacagcaaaaugauguuagaacuggacccacccuucggcgacucauacauaguaauaggcgucggagacaagaaaaucacgcaucacuggcaccgcagcggcagcacaauuggcaaggcauucgaagcaacagucagaggagcgaaacgaauggcaguacucggcgauacagccugggacuuuggauccgugggaggcguguucaacagccucggaaaagguauccaccaaaucuucggcgcagcguucaaaucacuauucggcggcaugagcugguucagccaaauacucaucggaacacuccuaguauggcuaggacucaacaccaaaaacggcagcaucagccugacaugccuagcgcucggaggagucaugauauuccucucaaccgcagugucggccgacguagggugcagugucgacuucagcaaaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9525 - RNA, 2365 nt, Artificial Sequence
  KF268950.1 prME-long mRNA Design 3 opt
gggagaaagcuuaccaugagaauaaucaacgcccgcaaagagcgcaaaagaaggggagcagacacgagcauaggcaucaucggacuccugcucaccaccgcaauggcagcagaaaucaccagaagaggaucagccuacuacauguaccuggacagaagcgacgcgggaaaagcaauauccuucgcaacgaaucuaggcgucaacaaaugccacguacagaucauggaccuaggucauaugugcgacgccaccaugucauacgaaugcccaaugcuagacgaaggcgucgaaccagacgacgucgacugcuggugcaacaccacguccaccugggugguauacggcacaugccaccacaagaaaggcgaagcccgaaggagcagacgcgcugucacccuaccaagccacaguacgcgcaagcuccaaacaagaagccagaccuggcuagaaagccgcgaauacacaaagcaccuaaucaaagucgaaaacuggaucuuccgaaacccaggauucgcccucgcagccgucgcaaucgcauggcugcuaggaagcuccaccagccaaaagguaaucuaccuggucaugauccuacugaucgcacccgccuacucgauucgaugcaucggcguaucgaaccgcgacuucgucgaagguaugagcggcggaaccugggucgacgucguacuagaacauggcggcugcguuacaguaauggcacaagauaagcccaccguagacaucgaacucgucaccacgaccguaagcaacauggcagaaguccgcucuuacugcuacgaagcaagcaucagcgacauggcaagcgacucacgauguccaacccaaggggaagcauaccucgacaagcaaagcgauacacaauacguaugcaaaaggacccucgucgaccgaggcuggggaaacggaugcggacucuucggcaaaggaagccuaguaacaugcgccaaauuuacaugcagcaagaaaaugacaggcaaaaguauccagccagaaaaccucgaauaccgcaucaugcuuagcguacacggcagccaacacucaggaaugaucgucaacgacauaggacacgaaaccgacgaaaacagggcgaaaguagaagucacacccaacuccccacgagcagaagcuacccugggcggauucgggagccugggccucgacugugaaccgagaacaggacuagacuucagcgaccucuacuaccucacaaugaacaacaaacacuggcuggugcacaaagaaugguuccaugacauaccgcucccauggcacgcaggagccgacacaggaacaccgcacuggaacaacaaagaagcccuagucgaguucaaagacgcacacgcgaaaaggcagacagucgucguccugggaucacaggaaggcgcaguacacacagcacucgccggcgcguuagaagcagagauggacggugccaaaggacgacuguuuucagggcaccucaaaugccggcuaaaaauggacaaacugcgccucaaaggaguaucauacagcuuaugcaccgccgccuuuaccuucaccaaaguccccgcagaaacccuccacggcaccguaacaguggaaguacaauacgcagggaccgacgggccaugcaagguaccugcacaaauggccgucgacaugcaaacacucacacccgucggaagacuaaucaccgccaacccaguaauaacagaaagcacagaaaacagcaaaaugaugcuagaacuagacccaccauuuggagacagcuacaucgugaucggagugggcgacaagaaaauaacccaucacuggcaccgcucaggcagcacaauaggcaaagccuucgaagcaacagucagaggagcgaaaagaauggccguacugggagacacugccugggacuucggcuccgucggcgggguauucaacagccuuggcaaaggcgugcaccagauauucggggccgcguucaaaaguuuauucgggggaaugaguugguucucccaaauacuaauaggcacacuucuaguauggcucggacuaaauacgaaaaacggaagcauuagccucacaugcuuagcccucggcggaguuaugauauuccucaguacagcagugucagccgacgugggaugcuccguagacuucagcaaaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9526 - RNA, 2365 nt, Artificial Sequence
  KF383121.1 prME-long mRNA Design 3 opt
gggagaaagcuuaccaugcgcaucauaaacgcacgcaaagaaaggaaacgcagaggagcggacaccuccauaggaauaauaggccuacuacucacaaccgccauggcggccgaaaucacgcgacgaggaucugcguacuacauguaccuggaccgcagcgaugccggaaaagccaucuccuucgcaacgacgcucggagucaacaagugccauguacaaauaauggaccucggucacaugugcgacgccacgaugucauacgaaugcccgaugcucgacgaaggcguagaaccagacgacgucgauugcuggugcaacacaacgagcacaugggucguauacggcacuugccaccacaaaaagggagaagcacgccgcagccgccgagcagucacacugccaucccacagcacgcgcaaacuacaaaccaggagccaaacguggcuagaaagcagagaauacacgaaacaccugaucaaagucgaaaacuggauauuccgaaaccccggauucgcccugguagcaguagcaaucgcauggcuacuaggcuccagcacaucccaaaaggucauauaccuaguaaugauacuacucaucgcaccagccuacagcauaagaugcaucggcguaagcaaccgcgacuucgucgaaggaauguccggcgggaccuggguugacguaguacucgaacacggcggaugcgucaccgugauggcacaagacaaacccacgguagacaucgaacucgucacaacgacagucagcaacauggcggaagugcguucguacugcuacgaagccagcauaucagacauggcauccgacucaagaugcccaacacaaggcgaagccuacuuagacaaacaaucagacacccaauacgucugcaaacggacacuugucgaccgcggauggggaaacggaugcggacuauucggaaaaggcucgcuagugacaugcgcaaaguucacaugcucaaagaaaaugacaggcaaauccauacaaccagaaaaccuugaauaucgaauuaugcucagcguccacggcucccaacacucaggaaugauagucaacgacauaggacacgaaacagacgaaaacagagccaaaguggaggucacaccaaacucccccagagcagaagcaacacuaggaggauucggaucccugggacuagacugcgaacccaggacaggccuugacuucuccgaccucuacuaccucaccaugaacaacaaacacuggcucguccacaaagaaugguuccacgacauaccccugcccuggcaugccggggcagacacagggacaccccacuggaacaacaaagaggcucugguagaguucaaagacgcgcacgcgaaaagacaaacagucgucguccucggcucccaggaaggcgccguacauacagcacucgcuggcgcgcuagaagccgaaauggacggcgcaaaaggcagacucuucuccggacaccuaaaaugccgacucaaaauggacaaacuacgacugaaaggcguauccuacagccuauguacagcagcauucaccuucacuaaaguaccagccgaaacccuacacggcacaguaaccguagaaguccaguacgcaggaacagacggccccugcaaaguaccagcacagauggcagucgacaugcaaacgcugaccccgguagggaggcucauaaccgccaacccaguuaucacggaaucaaccgaaaacagcaaaaugaugcucgaacuggacccacccuucggcgauucauacauaguaauaggaguaggcgacaagaaaauaacccaccacuggcacagauccggcagcaccauaggcaaagccuucgaggccacaguacgcggcgccaaaagaauggccguacucggagacaccgcaugggacuucggauccgucggaggcguauucaacagccucggcaaaggaauccaccaaauauucggagccgccuucaaaagccuauucggaggcaugagcugguucagccaaauccuaaucgggacgcuccuaguauggcuaggccucaacaccaaaaacggaagcaucagccuaaccugucuagcccugggcggcguaaugaucuuccuaagcaccgcggucagcgccgacguaggcugcagcguugacuuuucaaaaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9527 - RNA, 2347 nt, Artificial Sequence
  KF268949.1 prME-long mRNA Design 3 opt
gggagaaagcuuaccaugagaauaaucaacgcaaggaaggaaaggaaaaggaggggcgcagacacgagcauagggauaaucggccuacuacugacaacagcgauggccgccgaaauaaccaggaggggcagugcauacuacauguaccuggacagaagcgacgccgggaaagcgaucucguucgcgacuaaccucggcgucaacaagugccacgugcaaauaauggaccucggccacaugugcgacgcaaccaugucguacgaaugcccgaugcuagacgaaggaguggaacccgacgacguagacugcuggugcaacacaacgagcaccuggguaguauacggaaccugccaccacaagaaaggcgaagcgcgccggagccggcgagcggucacacucccaagccauagcacacgaaaacuccagacccgcagccagacauggcuagaaagcagagaauacacaaagcaccugaucaaagucgaaaacuggauauucagaaacccaggguucgcacuagcagcgguagccaucgccuggcugcuaggcagcuccacuagccagaaggucauauaccucguaaugaucuuacucaucgcgccagcauacucaauaaggugcaucggcgugagcaaccgcgacuucgucgaaggcaugucgggaggaaccugggucgacgucguccuagaacacggcggcugcgucacaguuauggcacaggacaagcccacaguagacauagaacucgucacaacaaccgugagcaacauggccgaaguacgaagcuacugcuaugaagcgucaaucucagacauggcaucagacagccgaugccccacacagggggaagcauaccucgacaagcaaagcgacacccaauacguauguaaacgaacccucgucgacagaggaugggggaacggauguggccuauucggaaaaggcagccucgugaccugcgcaaaauuuaccugcucaaagaaaaugacgggaaagagcauccaacccgaaaacuuagaauacagaaucaugcuauccguccauggaucccaacacagcggcaugauagucaacgacgaaaacagagccaaaguggaggucacgccaaacagcccaagagccgaagccacccucggcggauucggcagcuugggccuagauugcgaacccaggaccggacuagacuucuccgaucuuuauuaccugaccaugaacaacaaacacuggcuaguacacaaagaaugguuccacgacaucccacuaccauggcacgcaggagcagacacagggaccccgcacuggaauaauaaagaagccuuggucgaguucaaagacgcacacgcgaaacgccaaaccguaguaguacuaggcucccaagaaggugcgguccacaccgcucuagccggagcccucgaagcagaaauggacggcgccaaaggccgacuguucucaggccaccuaaaaugucgacuaaaaauggacaaauuacgccucaaaggcguaaguuacucgcucugcacagcggcauucaccuucaccaaagugccagccgaaacuuuacacggaaccguaaccgucgaaguacaauaugcgggaacagacggacccugcaaaguuccagcucaaauggcggucgacaugcagacgcucacccccgucggccgacucauaaccgccaaccccgucauaacugaaagcacagaaaacucaaagaugauguuagaauuagacccacccuucggcgacucauacaucguaauaggcguaggagacaagaaaauaacccaccacuggcaccgaucagguagcacgauagguaaagcauucgaagccacagucagaggcgcaaaacgcauggcagugcugggcgacacagcgugggacuucggauccgucggcggaguauucaacucacucgggaaagggauccaccaaauauucggagccgcauucaaaucccuauucggcggaaugagcugguucucccaaauacuaauaggcaccuuauugguauggcuagggcucaacaccaaaaacggaagcauaagccugaccugccuagcacucggaggagucaugauauuccucagcaccgcagucagcgcagacgucggaugcagcguggacuuuagcaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9528 - RNA, 2365 nt, Artificial Sequence
  KU955595.1 prME-long mRNA Design 3 opt
gggagaaagcuuaccaugagaauuaucaacgcccgaaaagaacgcaagcggcgaggcgcagacaccucaauaggaaucgucggccuacuacuuaccacagcgauggcggcagaaaucacacgacgcggcagugcauacuauauguaccuagaccgcucagacgccggcaaagcaaucaguuucgcaaccacccucggcgucaacaagugccacguccaaauuauggaccuaggccacaugugcgacgccaccauguccuacgaaugccccaugcuugacgaaggagucgaacccgacgacgucgacuguuggugcaacaccacaagcaccugggucgucuacggcacaugucaccacaagaaaggcgaagcgcgaaggagcagacgagcgguaacccuaccaucccauuccacccguaaacuucaaacacgcagccaaaccuggcucgaaagccgagaauacacaaaacaccuaaucaaagucgaaaauuggauauuccgcaacccgggguucgcucuagucgccguggccauagccuggcuccuaggcuccucaacgucacaaaagguaauauaccucgucaugauacuccuaaucgcaccagcguacagcauccgaugcauaggcgucagcaaccgcgacuucguggaggggaugagcggaggcaccuggguagaugucguacucgaacauggaggcugcgucacagucauggcacaagacaagccaacaguggacauagaacucgucacaacgacgguuagcaacauggccgagguacgaagcuacugcuacgaggccagcauaucagacauggccagcgacucaaggugccccacccaaggggaagcauacuuggacaaacaauccgacacccaauacgucugcaaacggacccugguggaccgaggguggggcaacggcugcggccucuucggaaaagguucccucguuacaugcgccaaauuuacgugcagcaagaaaaugaccggaaaaucaauacaaccugaaaaccucgaauacagaauaaugcucagcguccacggcucgcaacacagcggaaugaucguaaacgacaccggacacgaaaccgacgaaaaccgcgccaaagucgaagucacaccaaacuccccacgcgccgaagccacacucggcggauucgguagccuaggacuggacugcgaaccacgcacaggacuagacuucuccgaccucuacuaccuaaccaugaacaacaaacacuggcucguccacaaagaaugguuccacgacauaccccucccauggcaugcgggcgccgacaccggcacaccccacuggaacaacaaagaagcucuaguagaguucaaagacgcacacgcuaaacgccaaaccgucguaguccuuggcucccaagaaggcgcuguacauaccgcccuagcuggugcccucgaagcagaaauggacggagccaaaggacgccuguucuccggccaccucaaaugccgccucaaaauggacaaacuccgccucaaaggaguaucauacucccuaugcaccgcagcuuucacguucacaaaagugccagccgaaacacuacacggaacagugaccgucgaaguccaauacgccggcaccgacggacccugcaaaguacccgcccagauggccguagacaugcagacccuuacccccgucggaagacuaaucaccgcaaacccagucaucaccgaaucaacagaaaauagcaaaaugaugcucgaauuagacccacccuucggcgacucauacaucgucauuggcguaggcgacaagaaaauaacccaccacuggcacaggucagguuccaccaucggcaaagcauucgaagccaccguacgaggcgccaaacgcauggcaguccuaggagacaccgcgugggacuucggcagcgugggaggaguuuucaacucccucggaaaaggaauccaccaaaucuuuggcgcggcauuuaaaagucuauuuggaggaaugagcugguucucacaaauucugauaggcacccuccucgucuggcuaggucuaaacaccaaaaacggcaguaucucacuaaccugccucgcacuaggagggguaaugaucuuccucaguaccgcagucuccgcagacguugggugcagcgucgacuucuccaaaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9529 - RNA, 2365 nt, Artificial Sequence
  KF383116.1 prME-long mRNA Design 3 opt
gggagaaagcuuaccaugcgaauaaucaacgcgaggaaagaacgaaagagacggggcgcggacacauccauaggcauaguagggcugcugcuaacaacggcgauggcagccgaaauaacaagaaggggaagcgccuacuacauguaucucgaccgaucggacgccgggaaagcaaucagcuucgcaaccacccucggaguuaacaaaugccacguacaaaucauggaccuaggccacaugugcgacgccacaaugagcuacgaaugcccaaugcuggacgaaggcguggaacccgacgacgucgacugcuggugcaacacgacaagcaccuggguggucuacggcacaugccagcacaagaagggggaagcccgacgauccagacgcgcggucacacugccaagccacuccacccgcaaacuacagacaaggagccaaaccuggcucgaaagccgagaauacaccaaacaucucauaaaaguagagaacuggauauuccgaaacccuggguucgcccucgucgcgguggcaaucgcauggcuacuaggauccagcacgagccaaaaagucauauaccuaguaaugauacucuuaaucgcgccagcauacucaauccgaugcauaggcgucuccaacagagauuucgucgaaggaauguccggcggcaccuggguagacgucgugcuagaacauggaggcugcguaacaguaauggcacaagacaaaccaacagucgacaucgagcucgugacaacaaccguaaguaacauggcggaagugcgcucguacuguuacgaagccagcaucucugacauggcaagcgauagcagaugcccaacgcaaggcgaagcguaccucgacaagcaauccgacacacaguauguaugcaagaggacauugguagacagagguugggguaacggaugcggacuguucggaaaaggcucgcuaguaaccugcgccaaauucacaugcaguaagaaaaugacaggcaaaagcauacagcccgagaaccucgaauacaggauaaugcucucagugcacggaagccaacacagcggaaugauaguaaacgacauuggccacgaaacugacgagaacagagcaaaaguagaagugacacccaacagcccaagggcggaggcaacacuaggcggauucggcagccuaggccuagacugugaaccgcgaacaggccucgacuucagcgaccuauacuacuuaaccaugaacaacaaacacugguuggugcauaaagagugguuccacgacauaccacuuccauggcacgccggagcagacacagggaccccacacuggaacaacaaagaagcacuggucgaguucaaagacgcgcacgccaaacgacagacaguagucguccugggaagucaagaaggcgcgguacacaccgcacucgcaggcgcccuagaagccgaaauggacggcgccaaaggaaggcuguucaguggccaccuaaaaugcaggcucaaaauggacaaacuucgacugaaagggguaagcuacucguugugcaccgccguaugcacagccgccaaaguacccgcggaaacacuacacggcacggugacaguggaaguccaguaugccgggaccgacggacccugcaaggucccagcccaaauggcaguagauaugcaaacccucacgcccguagggcgacuaauaaccgcaaacccaguaauaacagaaucgacagaaaacagcaaaaugaugcuggaacucgacccgcccuucggagacagcuauauaguaauaggggucggagacaagaaaauaacacaccacuggcaccggagcggaagcacaauugggaaagcauucgaagcgacagugcggggagcuaaaaggauggcgguacuaggagacaccgcaugggauuucgggagcgucggcgggguauucaacagccuagggaaaggcauacaucaaauauuuggcgcagcuuucaagagccuauucgggggcaugagcugguucucacaaauacuaauaggaacccuccuagucuggcucgggcucaacacaaagaauggaucaauaagccuaacaugccuugcucucggaggcgugaugauauuccuaucaacagcggugagcgcggacgugggaugcuccguagacuucagcaaaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9530 - RNA, 2347 nt, Artificial Sequence
  KU963574.2 prME-long mRNA Design 3 opt
gggagaaagcuuaccaugcgaauaauaaacgcccgcaaggaaagaaaacgcaggggcgccgacgccucaauaggaaucgucucacuccuacucacaacagugauggccgcagagaucacgcgcagaggauccgcauacuacauguaccuagacagaagcgacgcaggaaaggcaauauccuucgucacaacccucggcgugaacaaaugccacguccaaauaauggaccuaggccacaugugcgacgccacaaugucauacgagugcccaaugcuggacgaaggcgucgaaccggacgacgucgacugcuggugcaacacaacguccacauggguagucuacggaaccugccaccacaagaaaggcgaagcacggaggagccggcgcgcaguaacauuaccaucacacaguacccgaaaacuccaaaccagaucccaaaccuggcuagagagccgcgaauacaccaaacaccuaaucaaaguggaaaacuggauauucagaaaucccggauucgcacucgucgccguagccaucgcauggcuacugggauccagcacaagccaaaaaguuaucuaccucguaaugauacuccugaucgcacccgcauacucaauaagaugcauaggcguaagcaaccgcgacuuuguagaaggaaugagcggagggacgugggucgacgucguacuagagcacggaggaugcgucaccgugauggcccaggacaaacccaccgucgacauugaacucgucacgaccacaguaagcaacauggccgaaguacggucauacugcuacgaagccucaauaagcgacauggcaucagacucacgcugcccaacacaaggggaagccuaccuagauaagcaauccgacacccaauacguaugcaaacgcacccuagucgaccgcggaugggggaacggaugcggacuauucggcaaaggaucgcuggugaccugcgccaaauucacaugcucaaagaaaaugaccgggaaaagcauccaaccagaaaaccucgaauaccguauaaugcuaucaguccacggcucucaacauucaggcaugaucgucaacgacgagaaccgcgcaaaaguagaggugacccccaacuccccaagagcagaggcgacccucggaggauucggcucacugggccuagacugcgaaccccgcaccggcuuagacuucagcgaccucuacuaccuaaccaugaacaacaaacacuggcuaguacacaaagaaugguuccacgacauaccacuucccuggcauucaggggccgauaccgaaaccccgcacuggaacaauaaagaagcccucguagaguucaaggacgcgcacgccaagagacagacagucguaguccuuggaagccaggaaggcgccguacacacugcccucgccggagcauuagaagccgaaauggacggcgcgaaaggccgacuaucaucuggccaccugaaaugccggcucaagauggacaagcugcgucucaagggagugucauacucacucugcacagccgcauucacauucaccaagguccccgcugaaacccuccacggaaccgugaccgucgaaguccaauacgccggacgagacggaccuugcaagguucccgcccagauggccgucgacaugcaaacccuaacacccgucggcagacuaaucaccgccaaccccgucaucacagaaucaacagaaaacucaaagaugaugcuagaacuagacccaccauucggggacagcuacauaguaauaggcgucggagacaagaaaaucacgcaccacuggcaccgcagugggucaauaauaggcaaagcguucgaagccacgguccgcggagccaaacgcauggcaguacuaggcgacaccgccugggacuucggaagcgucggaggcguguucaacucacucggcaaaggaauacaucaaauauucggcgcugccuucaaaucucuauucggagguauguccugguucucacaaauacuaaucggaacccuccucgucuggcucggacuuaacaccaaaaacgggagcaucucacugaccugccucgcccucggcggcguaaugaucuuccuaagcacagcaguauccgcagacgucggcugcagcguagacuucuccaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9531 - RNA, 2347 nt, Artificial Sequence
  KX601166.1 prME-long mRNA Design 3 opt
gggagaaagcuuaccaugcgcaucauaaacgcccgcaaagaaagaaaaagaagaggagccgacaccaguaucggaauaguuggacuccuccuaacaaccgccauggccgccgaaauaacccgccgcggcagcgcuuacuacauguaccucgacaggagcgaugcaggcaaagccaucucauucgccacaacuuugggcguaaacaaaugccacgugcaaaucauggaccucggccacaugugcgacgccacuauguccuacgaaugccccaugcucgacgaaggcguagaaccugacgacguagacugcuggugcaauacaaccagcaccuggguagucuauggaacaugccaccacaagaaaggugaagcacgccgaucacggagagccguaacccuacccucucacagcacccgcaaacuacaaacccgcucccaaacauggcuagagucacgcgaguacaccaaacacuuaaucaaaguggaaaacuggaucuuccguaaccccggcuucgcccucgucgcagucgccauagccuggcuccucggcucauccacaucccaaaaagucauauaccuaguaaugauacuccuuauugcaccagccuacagcaucagaugcaucggcgucucaaaccgagauuucgucgagggcaugucuggaggaaccugggucgacguaguccucgaacacggaggcugcgucaccguaauggcccaagacaaaccaacaguugacauagagcuagugaccaccacagugagcaauauggccgaaguucgauccuacugcuacgaagccagcaucucagacauggccagugacucucgcugccccacccaaggagaggccuacuuagacaaacaaagcgacacacaauacgucugcaagcgcacccucgucgaccgcggauggggaaacgguugcggauuauucggcaaaggcucucucguuaccugcgcgaaauucaccuguuccaagaaaaugaccggcaaaagcauccaacccgaaaaccuagaauacaggauaaugcucagcguccacggcucgcaacacuccggaaugaucgucaacgaugaaaaccgggccaaagucgaagucacgccgaacucaccaagagcugaagcuacacuaggcggcuucggaagccucggccuggacugcgaaccccgcacaggccucgacuucucagaccucuacuaccucaccaugaacaacaaacacuggcucguacacaaagaaugguuccacgacauaccccucccauggcacgcaggcgcagacacaggcacaccccacuggaacaacaaagaagcacucguggaguucaaagacgcccacgcaaaacggcaaacagucgucguacuaggcagccaagaaggcgcuguccacaccgcacuugcaggcgcccucgaagccgaaauggacggagcuaaaggcagacucuucagcggccaccuaaaaugccgccucaagauggacaaacugcgacuuaaaggcgucucguacucccuaugcacagcagccuucaccuucacaaaggucccggcggaaacacuacacgggaccguaaccgucgaaguacaauacgcaggaaccgacggccccugcaaaguacccgcacaaauggcggucgacaugcaaacacugacccccgucggacgccugauaaccgccaaccccgucauaaccgagucaacagaaaacagcaaaaugaugcucgaacuagacccucccuucggcgauucuuacaucgucauaggagucggcgacaagaaaaucacacaccacuggcacagauccgguucaacaaucggcaaagcauucgaggccaccguccgcggcgccaaacgcauggcagucuuaggcgacaccgccugggacuucggcagcguaggcggaguauucaacagucucggcaaaggcauccaccaaauauuuggcgccgcguucaaaagccuguucgggggcauguccugguucucccaaauccucauaggaacccuccuaguauggcuuggacuaaacaccaaaaacggcuccauaucccuaaccugccucgcucucggcggggugaugauauuccucagcacagcaguguccgccgacgucggcugcuccguugacuucuccaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9532 - RNA, 2365 nt, Artificial Sequence
  KF383118.1 prME-long mRNA Design 3 opt
gggagaaagcuuaccaugcgaaucauaaacgcaagaaaagaaagaaaaaggagaggcgccgacaccucaaucgguauaaucggccuacuccucacaacggccauggccgcagaaaucacaagacgaggcuccgcauacuacauguaccucgaccguucagacgcgggcaaagcaauaucauucgccacaacccucggaguaaacaaaugccacguccaaauaauggaccuaggacacaugugcgacgccacuaugagcuacgaaugcccaaugcuagacgaaggagucgaacccgacgacgucgacugcuggugcaacaccaccucgaccuggguaguguacgggaccugccaccacaaaaagggggaaacccgaagaucccggaggagugugagccuaagguaccacuacacacgaaaacuccagaccagaagccaaaccuggcuggaauccagagaauacaagaaacaccucauaaugguagaaaacuggauauucagaaacccaggauucgcgauagucagcguggcaaucacauggcuaaugggaagccucaccucccaaaaaguaauauacuuagugaugaucguccucauaguaccagccuacagcaucagcugcaucggagucagcaaccgcgacuuagucgaggggaugucgggcgggacaugggucgacguaguacucgaacauggaggcugcguaacagaaauggcacaagacaaacccaccguagacaucgagcucguaaccaugacagucucaaacauggccgagguccggucguacugcuacgaggcgucccugucagauauggcaagcgccuccagaugcccuacccaaggcgaaccaagucucgacaaacaaucagacacccaaagcguaugcaaaagaacacucggagacagggguuggggaaauggcuguggaauauucggaaagggaagccuaguaacaugcaguaaguuuaccugcugcaagaagaugccaggaaaaucaauacaaccagaaaaccuggaauaccgaauaaugcuccccguacacgguucacagcacagcggcaugaucguaaacgacauuggacacgaaacagaugaaaacagggccaaaguggaagugacaccgaacagcccacgcgcagaagccacccucggaggcuucggcucacucggacuggacugcgaaccacguacggggcuugacuucagcgaccucuacuaccugacgaugaacaacaaacacuggcuaguacacaaagagugguuccaugacauaccccuacccuggcacgccggcgcagauacaggcacgccucacuggaacaacaaggaggcacucgucgaguucaaagacgcccacgcaaaaaggcaaaccguagucgugcucggcucccaggaaggagcaguacauacagcacuggccggagcccuagaagcagaaauggacggagccaaaggacgccucuucucaggccaccugaaaugcaggcucaaaauggacaaacugagacucaagggcguaagcuacagccucugcacagcagccuucacauucaccaaagugcccgcagaaacacuccacggaacggucaccgucgaaguacaauccgccggaacagacggccccugcaaaguacccgcacaaauggcugucgacaugcaaacauuaacacccgucggacgacugaucaccgcaaauccgguaaucaccgaauccacagaaaauagcaaaaugaugcucgaacucgacccacccuucggagacagcuacauagucaucggcgucggugacaaaaagaucacccaccacuggcacaggagcggcagcacaauaggaaaagccuucgaagcaaccgugcgaggagcgaaaagaauggcaguguuaggcgacaccgccugggacuucggcucaguaggaggaguguucaacagccuaggaaaaggaauacaccaaaucuucggcgcggcauucaaaagucuuuucggaggaaugagcugguucagccagauauuaauaggcacccuccucguauggcuaggucuaaacaccaaaaacggcuccaucucacuaaccugccucgcgcuaggcggagucaugaucuuccucagcacagccgucuccgcagacguagggugcucagucgacuucagcaaaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9533 - RNA, 2359 nt, Artificial Sequence
  KF383120.1 prME-long mRNA Design 3 opt
gggagaaagcuuaccaugcgcauaauaaacgcccgaaaagaacgcaaacgaagaggcgccgacacaucaauaggaauaauaggccuccucuuaacgacagcgauggcagccgaaauaaccaggagggguucagccuauuacauguaccuggaccgcagcgacgcaggaaaagccaucucguucgcaacaaccaugggagucaacaagugccacguacaaaucauggaccuaggacacaugugcgacgccacaauguccuacgaaugcccuaugcuagacgaaggcguagaacccgacgacgucgacugcuggugcaacaccaccagcacaugggugguauacggaaccugccaccacaagaaaggagaagcgagaccguccagacgagcgguaacacugccgagccacuccacccgcaaacuucaaaccaggucacaaacauggcucgaaagcagagaauauacaaagcaccuaaucaaagucgaaaacuggauccuccgcaacccaggauucacaguggcagcacuagcaauggccuggcuacugggaaacagcaccucacaaagagucaucuaccuagucaugauccuacuaaucgcccccgccuacucgaucaggugcaucggcguuagcaaccgggacuucguagaaggcaugagcggcggaacaugggucgacguagugcucgaacacggcgggugcgucacaguaauggcacaagacaaacccacagucgauaucgagcuagucaccacaacaguaagcaacauggccgaagucaggucguacugcuacgaagcaagcauaagcgacauggcaagugacagcagaugccccacccaaggggaagccuaccuagacaaacaauccgacacccaauacgucugcaagcgcacccuagucgacagaggguggggaaacggcugcggccuauucggcaaaggaucccuaguaacaugcgcaaaauuuaccugcagcaaaaagaugacaggcaaaucaauccaacccgaaaaccucgaauacagaaucaugcucucaguccacgguucacaacacucggggaugaucgucaacgauaucggacacgaaaccgaugaaaacagagcaaaggucgaagucacuccaaacuccccuagagccgaagcaacccucggaggauucggcucccucggccuagacugcgaaccacgcaccgggcucgacuucagcgaccuauacuaccuaacaaugaacaacaaacacuggcugguacacaaagaaugguuccacgacauaccacuaccuuggcacgcaggggccgacaccggcacaccccacuggaacaacaaagaagcgcuaguagaguucaaggacgcacacgcaaaaagacaaaccgucguaguacuaggaagccaggaaggcgcgguccacaccgcgcuggccggcgcacuagaagccgaaauggauggagcaaaagggcgccucuucuccggccaccucaaaugccggaucaaaauggacaaguuaagacuaaaaggcgucucauacagccuuugcacagcagccuucacauucucgaaagugccggcagagacacugcacggcaccguaaccgucgaaguacaauaugcaggcagagacggcccaugcaagguacccgcacaaauggcagucgacaugcagacacuaaccccagucggccgccuaauaacagcaaaccccaucaucacagaaagcacagaaaacucccgcaugaugcucgaacuagacccacccuucggcgacagcuacauaguaaucggggucggcgacaagaaaauaacacaccacuggcaccgaagugggagcacaaucggaaaagcauucgaagccacagucagaggagccaaacggauggcaguccucggcgacaccgcaugggacuucggaagcgucggaggcgucuucaacucauugggcaaaggaguccaccaaguuuuuggggccgcauucaaaagccuguucggagggaugagcugguucucgcaaauacuaaucggcacccugcucgucuggcucggccucaacacaaagaacggaucuaucucacuugcaugccucgcacucggcggcgccaugaucuuccuauccacggcagucagcgccgacguaggcuguagcguagacuucugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9534 - RNA, 2290 nt, Artificial Sequence
  KU321639.1 prME-short mRNA Design 3 opt
gggagaaagcuuaccaugacaucaguaggaauaguaggccugcuacucaccaccgcaauggccgcggaagucaccagaagagggagcgcauacuacauguaccuagacaggaacgacgcgggagaggccauaucauucccaacuacgcuagguaugaacaaaugcuauauccaaauaauggaccuagggcauaugugcgacgccacgaugaguuacgagugccccaugcuagacgaaggggucgaaccggacgacguagacugcuggugcaacacaaccucaaccuggguagucuacgggaccugccaccacaagaaaggcgaagcacgccgaucaagacgagcgguaacccucccaagccacucgacaagaaaacuccaaacccgaagucaaaccuggcucgaaucucgcgaauacaccaaacaccucauucgaguagaaaacuggaucuuccggaacccaggcuucgcguuagccgccgccgccauagcauggcuacuuggaagcuccaccucccaaaaagucauauaccuaguaaugauccuccucauagcgccagccuacuccauuagaugcauaggcguaagcaauagagacuucgucgaaggcaugagcgggggcacguggguugacaucguccuggagcacggcggcugcguaacaguaauggcccaagacaaaccaaccguugacaucgagcuagugacgacaaccguaucaaacauggcagaaguaagguccuacugcuacgaagcaagcaucuccgacauggcaucagacagcagaugcccgacacaaggagaagcauaccuagacaagcaaagcgacacccaguacguaugcaaaagaacgcuggucgaccgcggauggggaaacggaugcggccuauuuggcaaaggaagccuaguaaccugcgccaaauucgcaugcuccaaaaagaugacaggcaaauccauccaaccagaaaaccuagaauaucgaaucauguuaagcguacacggaagucaacacucaggcaugaucgucaacgacacaggacacgagacagacgaaaacagagcaaaagucgaaaucacaccaaauucaccccgagcagaagccacccuagggggcuucggaucgcucggccuagacugugaaccacgcaccggacuggauuucagcgaccuauacuaccuaaccaugaauaacaagcacuggcucguacacaaagaaugguuccacgacauaccacucccauggcacgccggcgccgacacagggacgccacauuggaacaacaaagaagcacucguagaauuuaaagacgcccacgccaaacgacaaacagucguggucuuggggucccaagaaggcgcgguccacacagcacucgccggcgcccuggaagcggaaauggacggcgccaagggcagacugucaucgggccaccuaaaaugccgacuaaagauggacaaacuccgccucaaaggcguaucauacucccucugcacggcagcauucacauucaccaaaauacccgcggaaacacuacacggcaccgucacaguagaaguccaauacgccggaacggacgggccguguaagguccccgcccaaauggccgucgauaugcaaacccugacuccagucggccgacuaaucacagcaaaccccgucauaacugaauccacagagaacaguaagaugaugcucgagcucgacccacccuucggcgacagcuacauaguaaucggagucggcgagaagaaaauaacacaccacuggcaccgcagcggauccaccauaggcaaagccuucgaagccaccguccgaggugccaaacgcauggcaguacugggcgacacagccugggacuucggcagcgucggaggagcccuaaacagccugggaaaaggcauacaccaaaucuucggagccgccuucaaaucccuuuucggaggcauguccugguucagccaaauccugaucggcacccugcuuauguggcuaggccuaaacaccaaaaacggauccaucagccuaaugugccuggcccuaggcggugugcuaaucuuccuaagcacugccguaucagcuugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9535 - RNA, 2290 nt, Artificial Sequence
  KU312312.1 prME-short mRNA Design 3 opt
gggagaaagcuuaccaugacuucagucggcaucguaggccuacuccucaccaccgccauggcagccgaaguaacccgccgcggcuccgcauacuacauguaccucgacaggaacgacgcuggcgaagccaucuccuuccccacaacccucggaaugaauaaaugcuacauccaaaucauggaccucgggcacacaugcgacgcaacuauguccuaugaaugccccaugcuagacgaaggcgucgaacccgaugacgucgauugcuggugcaacacaaccucaaccuggguagucuacggaaccugccaccauaagaaaggcgaagcccgcagaucccgacgcgccguaacacuaccgucccacuccacgcgcaaacuccagacaaggagccagacauggcuagaaagccgcgaauacaccaaacaccuaauaagaguagagaacuggaucuuccgaaacccaggauucgcacucgcagcagcagccaucgcauggcuacucggauccagcaccucccaaaaaguaauuuaccuggucaugauccugcuaauagcgcccgcauacagcaucaggugcauaggggucuccaauagagacuucguagaaggcaugagcggcggaacguggguagacgucguacucgaacacggcggcugcgucacuguaauggcccaagacaaaccuacgguugacaucgaacucguaacaacaaccgucucaaacauggccgaaguacgauccuacugcuacgaagccucaauauccgacauggccuccgacagccggugccccacgcaaggcgaagcauacuuagacaaacaaagcgacacacaauacgucugcaaacgaacacuggucgaccgcggcuggggaaacggcuguggacuauucggaaaaggcucacucguaacaugcgcaaaauucgccuguagcaagaaaaugacaggaaaaagcauccaacccgaaaaccucgaauaccgaaucaugcugucaguccacggaagccaacauucaggaaugaucgucaacgacacaggacacgaaacugacgaaaacagagccaaggucgagauaacaccaaacagcccacgugcagaagccacccuaggaggguucgggucacucggccuugacugcgaaccgcggacgggacuagacuucagcgaccuuuacuaccucacaaugaacaacaaacacuggcuaguucauaaagaaugguuccacgauaucccacugcccuggcacgcaggcgccgacacaggcacaccacacuggaacaacaaggaagcccucgucgaguucaaagacgcccacgcgaaaagacaaaccgucgucguacuaggcucacaagagggcgccguccacaccgcccuagccggcgcccuagaggcagaaauggacggcgcaaagggccgccucucauccgggcaccucaaaugccgccucaaaauggacaaacuccgucuuaaaggcgucucguauucccuaugcaccgccgccuucacguucaccaaaauaccggcagaaacgcuccacggaaccgucaccguagaaguacaguaugccggcacggacggccccugcaaagucccagcccaaauggccgucgacaugcagacacucaccccagucggcaggcuaaucacggcgaaucccgucaucacagaauccacagaaaacucaaaaaugaugcuagaacuagacccgccauucggcgacaguuacaucgucaucggagucggcgaaaagaagaucacacaucacuggcacagaagcggcagcacaauagggaaggccuuugaagcaaccgucagaggugccaaaagaauggcaguccucggcgacaccgccugggacuucggaucgguaggcggugcccucaacucccuaggaaagggcauccaccaaaucuucggugccgcauucaaaucccuauucgggggcaugucaugguucucacagauacuaauaggaacccuccucauguggcuaggccuaaacgccaaaaacggcagcauaagccugaugugccuagcccucggcggcguacuaaucuuccucagcacagccgucucagcaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9536 - RNA, 2278 nt, Artificial Sequence
  AY632535.2 prME-short mRNA Design 3 opt
gggagaaagcuuaccaugacgagcauaggcauaauaggacucuugcucacaaccgcaauggccgccgaaaucacgcgacgaggcucagccuacuacauguaccuagacagaagcgacgcaggcaaagccaucucguucgcaaccacacucggaguaaacaaaugccacguacaaauaauggaucucggacacaugugcgaugcaacaauguccuacgagugccccauguuagacgaaggaguagaaccggacgacgucgacugcuggugcaauaccacaagcacguggguaguauauggcacgugccaccacaagaaaggcgaagcacgcagaagccggcgcgccgucacgcuacccagccauagcaccagaaagcuccagacacggucccaaaccuggcucgagagccgcgaauauacaaaacaccugaucaaggucgaaaacuggaucuuccggaauccuggauucgcacucgucgccguugcaaucgcuuggcuccuaggcucgagcacgagccaaaaaguaaucuaccucguaaugauacuacuaaucgcgcccgcauauucuauccgaugcauaggcgugagcaaccgugacuucgucgaaggaaugucgggcgggacaugggucgauguaguacuagagcacgggggaugcgucacggucauggcacaagacaagcccaccgucgauaucgagcucgucacgaccacagugagcaacauggcugaagugcgcucauacugcuacgaagccuccauaucagacauggcauccgacagcagaugcccuacacaaggugaagcauaccuggacaaacaaucagacacacaauacgucugcaaaaggacccuagucgaucgcggaugggggaacgggugcggacuauucggcaaaggaagccuagugaccugcgcuaaauuuaccugcucgaagaaaaugacaggaaagagcauccaacccgaaaaccucgaauacagaaucaugcucucaguccacggcucucaacauagcgggaugauaggcuacgaaacugacgaggacagagccaaagucgaggucacgcccaacagcccgcgcgcagaagcuacacugggaggauucggcagccuaggacuagacugcgaaccacgcacaggacucgacuucagcgaccuauacuaccugacaaugaacaacaaacacuggcuaguccacaaagaaugguuccacgauauaccgcucccguggcacgccggcgccgacaccgguaccccacacuggaacaacaaagaagcacucgucgaguucaaagacgcacacgcaaaaagacaaacggucguaguauuaggcucgcaagaaggcgcaguccacacagcccuagcaggcgcgcuagaagcagaaauggacggcgcgaaaggcagacuauucucaggccaucucaagugccgccuaaaaauggacaaacuccgccuaaaagggguauccuacucacucugcacagcagcauucacauucaccaaaguccccgcggaaacccuacauggcacaguaaccguagaagugcaauaugccggaacggauggccccugcaagaucccgguacaaauggcgguugacaugcagacucugaccccaguagggcgccuaaucacagcaaacccuguaaucacugaauccacagaaaacucaaaaaugaugcucgaacuggacccaccauucggggacagcuacauaguaauaggagucggcgacaagaaaaucacccaccacuggcacagaagcgggaguacaaucggaaaagcguucgaggccacagucaggggcgcaaaaagaauggcaguacuaggagacaccgcuugggacuucggcagcgugggcgggguauucaacucacucggaaaaggcauccaccaaaucuucggugcagccuucaaaagccuguucggaggaauguccugguucucccaaauucucaucggaacgcuccuagucuggcucggacuaaauaccaaaaacggaucuaucagcuuaaccugccucgcgcuaggaggagugaugaucuuccuguccacagcaguguccgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9537 - RNA, 2290 nt, Artificial Sequence
  KU527068.1 prME-short mRNA Design 3 opt
gggagaaagcuuaccaugaccuccguaggcaucguaggccuacuccugacgaccgccauggccgccgaagucacccgccgcggcuccgcauacuacauguaccucgaccgaaacgacgccggagaagccaucagcuuucccacuacccucggcaugaacaaaugcuacauccaaaucauggaccucggucacaugugcgacgcuacuaugagcuacgaaugucccaugcuagacgagggaguugaacccgacgacgucgacugcuggugcaacacaacaucaacaugggucguauacggcaccugucaccacaagaaaggcgaagcaagacguucuagacgagccguaacacuaccaucccauucgacccgcaaauuacaaacccgcucccaaaccuggcuagaaucacgagaauacaccaaacaccucauccgcgucgagaacuggaucuucaggaacccgggauucgcacuugcugccgcagcaauagcauggcuccucggauccuccaccucccaaaaaguuauauaccucgucaugauccuccuuaucgcccccgcauacucgauccgcugcauaggugucucaaaccgagacuucguggaaggcauguccgggggcacguggguagacguggucuuagaacacggcggcugcguaaccguaauggcacaagacaaaccaacaguggacaucgaacuggucaccacaacaguauccaacauggccgaaguccgcagcuauugcuacgaagcaagcauaucugauauggcguccgacucacgcugccccacucagggcgaagccuaccuugacaagcaauccgacacccaauacgucugcaaacgcacacucgucgaccgaggcuggggcaacggaugcggacuauucggaaagggcucccuagucacaugcgccaaauucgccugcuccaagaaaaugaccggcaaaucgauacaacccgaaaaccucgaauaccguauaaugcuauccguccacggcucacaacauucagggaugaucgucaacgacacaggccacgaaaccgacgaaaaccgagccaaggucgaaauaaccccgaacagccccagagccgaagccacccuaggaggcuucggcucccuaggccuagacugcgaaccccgcaccggccucgacuucuccgacuuguacuaccucacgaugaacaacaaacacuggcuaguccacaaagaaugguuccacgacauaccccucccauggcacgccggcgcagauaccggaacuccccacuggaacaacaaagaagcccuagucgaguucaaagacgcccacgccaaacgccaaacagucguaguccuaggaucccaagaaggcgccguucacacggcacucgccggagcacuagaagccgaaauggacggcgcaaaaggccgucuauccucaggccaccuuaaaugccgccugaagauggauaaacuccggcucaaaggagucuccuacucacugugcaccgccgcauucacauucaccaaaaucccagccgaaacccuccacggcacaguaaccguugaaguccaauacgccggcaccgauggcccaugcaaaguaccggcccaaauggcaguagacaugcaaacacucacacccguaggacgccucauaacggccaacccaguaauaaccgaauccacagaaaacuccaaaaugaugcuagaacuagacccacccuucggggacuccuacaucgucaucggcguaggcgaaaagaaaaucacacaucacuggcaccgcucaggaucaacaauaggaaaagccuucgaagccacaguaagaggugcaaaacgcauggcaguacuaggagacacagcaugggacuuugggucagucggcggagcccugaacucacucggaaaagggauccaccaaaucuucggcgccgcauucaaaucccuauucggaggaaugagcugguucagccaaauccucaucgggacccuacuaauguggcucggccucaacaccaaaaacggcuccaucucccuuaugugucucgcucuaggcggcguacucauauuccucagcaccgccgucucugcaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9538 - RNA, 2290 nt, Artificial Sequence
  KX421193.1 prME-short mRNA Design 3 opt
gggagaaagcuuaccaugacgagcaucggcaucauaggucuccuccuaaccacggccauggccgccgaaaucacccgccgcggcuccgcauacuacauguaccuugaccgcucagaugccggaaaagcaaucucauucgcgacaacccucggaguaaacaaaugccacguacaaaucauggaccugggccauaugugcgacgccacgauguccuacgaaugccccaugcuagacgaaggggucgaacccgaugacguagauugcuggugcaacacaacaagcaccugggucgucuacggcacaugccaccacaagaaaggagaagcacgccgaucacgccgagccgucaccuuacccucucacucaacccgaaaacuacagacaagaucccagaccuggcuugaaagccgcgaauacacaaaacaccucaucaaagucgaaaacuggauauuccggaaccccggauucgcccuaguagcaguagcaauagcauggcugcucggauccucaacaucacaaaaaguaaucuaccucgucaugauccugcuuaucgcacccgccuacucaaucagaugcauaggagucagcaaccgcgacuucgucgaagggaugucaggaggcacgugggucgacguaguccuagaacacggcggcugcgucacaguaauggcccaagacaaaccuaccguagacaucgagcucguaaccaccacuguauccaauauggccgaaguccguucauauugcuacgaagccucaaucuccgacauggcaagcgacucccgaugccccacccaaggagaagcguaccucgacaaacaauccgacacccaguacgucugcaaacgaacuuugguagaccggggcuggggcaacggaugcggucucuucgguaaaggauccuuaguaaccugcgcaaaauuuaccugcagcaagaaaaugacaggaaaaucaauacaaccagaaaaccucgaauaccgcaucaugcucucaguccacgggucccaacacuccggaaugauagucaaugacacaggcuacgaaaccgacgaaaaccgcgccaaaguagaagucacacccaacagcccccgcgcagaggccacccucggcggcuucggcucccuaggccuagacugugaaccgcgaacaggccuggacuucuccgaccucuacuaccuuacuaugaacaacaaacacuggcucguccacaaagaaugguuccacgacaucccucuaccauggcacgccggagcagacaccggcacaccccauuggaacaacaaagaagcccuuguugaguucaaggacgcccacgcgaaacgacaaaccgugguaguacuugguucacaagaaggcgcaguccacacagcccuagccggagcccucgaagcagagauggacggagccaaaggcaaacucuucuccggccaccuaaagugcagacuaaaaauggacaaacuaagacuaaaagggguaucauacagccuaugcaccgccgcuuucaccuucacgaaagucccagccgaaacccuacacggcaccguaaccgucgaaguacaauacgcaggaaccgacggccccugcaaaauccccguccagauggccguagauaugcaaacacuaacccccgucggacgccuaauaaccgccaacccagucaucaccgaaagcacugaaaacuccaaaaugaugcuagaacucgacccgccauucggcgacagcuacaucguaaucggagucggggauaaaaagaucacccaccacuggcaccgcucaggcagcacgauaggcaaagccuucgaagccacaguccgcggggccaaacguauggcaguccuaggagacacggccugggacuucggcuccgucggcggagucuucaacucccuaggcaaaggcauccaccaaauauucggcgcggcauucaaaagccuauucggcggcauguccugguucucacaaauccuaauaggcacccuccuaguauggcuaggacuaaacaccaaaaacggauccauaagccuaaccugccuagcacuaggcggcguaaugauuuuccuaagcacggccgucagcgcaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9539 - RNA, 2290 nt, Artificial Sequence
  KX377335.1 prME-short mRNA Design 3 opt
gggagaaagcuuaccaugacgaguaucgguaucauaggccuacugcugacaaccgcgauggcugcagagaucacacguagaggaagcgcauacuacauguaccuggaccgcagcgacgccggaaaagcaauaucauucgccacaacgcucggaguaaacaaaugccacguccagauaauggaccucggucacaugugcgacgcaaccaugucguacgaaugccccaugcuagacgagggagucgaaccagacgacgucgauugcuggugcaacacaaccagcacgugggucguguacggaaccugccacagaaagaaaggggaagcgagaagaagcagacgagcggucacacucccuagccacagcacacgcaaacuccaaacccgaagccaaacguggcucgaaagccgagaauacacaaaacaccucaucaaagucgaaaacuggaucuuccgcaaccccggguucgcacucguggcagucgccauagcauggcuccugggcagcagcacgagccaaaaaguaaucuaccuagugaugauacuccugaucgccccagccuacucgauacgaugcauaggcgucagcaaccgcgauuucguggaaggaauguccggcgggacguggguagacguaguccuggaacacggaggcugcgucaccguaauggcccaggacaaacccacagucgauauagagcuggugacgacaacaguaagcaacauggcagaaguacgcucguacugcuaugaagcaucgaucucggacauggcaagcgacagccgcuguccaacccaaggagaggccuaccuagacaaacagagcgacacacaguaugucugcaaaagaacccucguagacagaggcuggggaaacggaugcggccucuucggcaagggaucgcuaguaacaugcgccaaauucacaugcuccaagaaaaugacaggcaaaagcauccagcccgaaaaccuagaguaccgaauaaugcugucaguccacggcucacaacacuccggcaugauaguaaacgacaccggcuacgaaacggaugaaaacagagccaaagucgagguaaccccgaacuccccacgagcagaagcaacucucggaggguucgggagccucggguuagacugcgaaccccgcaccggauuggacuucagcgaccucuauuaccugacaaugaacaacaaacacuggcucguccacaaagagugguuucacgacaucccccuccccuggcacgcaggcgccgacacaggaacgccacacuggaacaacaaagaggccuuggucgaguucaaagacgcacacgccaaaagacaaaccguggucguacucggcagccaagaaggagcaguacacacagcgcuagcaggcgcacuagaagccgaaauggacggagcaaaagggaaauuguucucuggccaccucaaaugcagacugaaaauggacaaacuaagacugaaaggagugucauacucacugugcacagcagcauucaccuucacaaaaguaccagcggaaacccuucacgggacaguaaccguagaaguccaauacgcaggaaccgacgggccgugcaagaucccagugcagauggccgucgacaugcagacccuaaccccagucgggcgacucaucaccgccaacccaguaauaacagaaaguaccgaaaacagcaaaaugaugcuugaacuagacccacccuucggagacagcuacauaguaauaggcgugggagauaagaaaauaacccaccacuggcacagaagcgggagcacaauaggaaaagcauucgaggccaccgucaggggagcaaaaagaauggcaguacucggagacaccgccugggacuucgggucugucggaggaguauucaacucacuagggaaaggaauccaccaaauauucggcgccgccuucaagagcuuauucgggggcauguccugguucagccaaauccuaauuggaacccuccuaguguggcuaggccuaaacaccaaaaacggaagcauaagucuaacaugucuagcccuaggcggcgugaugauauuccuaagcaccgcgguaagcgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9540 - RNA, 2290 nt, Artificial Sequence
  LC002520.1 prME-short mRNA Design 3 opt
gggagaaagcuuaccaugacaagcaucggcauaaucggacuauuacucacaaccgcaauggcagccgaaauaacccgccgaggaucugccuacuacauguaccucgacaggagcgacgccggaaaagcaauaucauucgcaacaacccuagggguaaacaagugccacguacaaauaauggaccucggccacaugugcgacgccacaaugagcuacgaaugccccaugcuggacgagggcguggaaccggacgacgucgacugcuggugcaacaccacuuccaccugggucguauacggaaccugccaccacaagaaaggggaagcacgaagauccagacgagccgucacauuaccaagccacucaaccagaaaacuacagacaagaagccaaacauggcucgaaagcagggaguacacaaaacaccugauaaaagucgaaaacuggauauuccgcaaccccggguucgcccucguggccguagcaauagccuggcuacuaggcuccagcacaagccaaaaagucaucuaccuagucaugauccuccuaaucgcgccagcauacuccauccgguguauaggcgucucaaacagagacuucgucgaagggaugucaggcggaaccuggguagacgugguacucgagcacggaggcugcguaacagucauggcccaagacaaacccaccgucgacaucgaacugguaacaaccaccguaagcaacauggcugaaguccgauccuacugcuaugaagccagcaucucagacauggcaagugacucacgaugcccaacccaaggcgaagccuaccuggacaagcaaagcgacacccaguacgucugcaaacgcacccuagucgaccgaggguggggaaacggcugcggccucuucggaaaaggaucgcuagucacgugugcaaaguuuaccugcuccaagaaaaugacaggcaaaaguauacagccugaaaaccucgaguaucgaaucaugcuaucugugcacggcucacaacacucaggaaugacggucaacgacauaggauacgagaccgacgaaaaccgcgcaaaagucgaggucaccccaaacagcccacgggcagaagccacccucggaggguucggcagccuaggccucgauugcgaaccaagaacaggccuugacuucuccgaccuauacuaucucaccaugaacaacaaacacuggcugguccacaaagaaugguuccacgacauaccacuccccuggcacgcaggcgcggacacagggacgccacacuggaacaacaaagaagcccuaguagaguucaaagacgcacacgccaaacgacaaaccgucgucguucuaggcucccaagaaggcgcaguccacacggcccuagcaggagcgcuagaagccgagauggacggcgccaagggcaaacucuucagcggacaccuaaaaugcaggcuaaaaauggacaaacuacggcucaagggaguaucauacucgcugugcaccgcggcguucaccuucaccaaaguacccgccgagacccuccacggaaccguaaccgucgaaguccaauacgcagggacugacggcccgugcaaaaucccaguccaaauggcagucgacaugcaaacacuaacaccagucgggcgacucaucacagcaaaccccguaaucacagaauccaccgaaaacuccaagaugaugcucgagcuagacccgccauucggagacagcuacaucguaauaggagucggagacaaaaagaucacccaccacuggcaccgcucgggaagcacaaucggcaaggccuucgaagcaacuguaagaggcgcaaaacgcauggccguacuaggagacaccgcuugggacuucggcagcgucggcgggguguucaacucccuaggaaaaggcauacaccaaauauucggagcagcuuuuaaaucccuguucggcggcaugagcugguucagccaaauacuaauaggcacccucuuagucuggcuaggacucaacacaaagaacggcucaaucucacuaaccugccucgcacuaggaggagucaugauauuccugagcacagccgucagcgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9541 - RNA, 2272 nt, Artificial Sequence
  DQ859059.1 prME-short mRNA Design 3 opt
gggagaaagcuuaccaugacaagcauaggcauagucggccugcuacucaccacugccauggccgccgaaauaacacgcagaggcuccgccuacuacauguaccucgaccgcuccgacgcaggaaaagccaucuccuucgcaaccacgcucggcgucaacaaaugucacguacaaauaauggaccuaggccacaugugcgacgccaccaugagcuacgaaugccccaugcucgacgagggcgucgagccggacgacguagacugcuggugcaacacaaccucuacauggguagucuauggaaccugccaucacaagaaaggcgaggcccgacgaagccgacgagcaguuaccuuacccagccacagcacacgcaaacuccaaacaagaagccaaacauggcuagagagccgagaauacacaaaacaccucaucaaagucgaaaacuggauauuccggaauccaggcuucacacucgucgcaguagcaauagccuggcuccucggcagcagcaccagccaaaaaguaaucuaccuagucaugauccuccuaauagcgccagccuacuccauaaggugcauaggaguaagcaaucgcgacuucguagaaggaaugagcggaggcaccugggucgacguaguccucgaacacgggggaugcguaacaguaauggcccaagacaagccaacaguagacauagagcucgucacaacgaccgucaguaacauggcagaagucaggucuuacugcuacgaagcaagcaucagcgacauggcaucagacagccgaugccccacccaaggagaagcguaccuagacaagcaaucagacacccaauacgucugcaaaaggacccuuguagauagaggauggggaaacggaugcggccucuucggcaagggcagccuaguaaccugcgcaaaauucacaugcucaaagaaaaugaccggcaaaucaauccaaccagaaaaccuugaauaccgaaucaugcucuccguccacggaagccaacacagcggaaugauagucaacgacgaaaacagagcaaaagucgaagucacucccaacucaccccgagccgaagccacccugggcggcuucggaucccugggacuugacugcgaaccucgcaccggccuagacuucagcgaccuauacuaccucacaaugaacaacaaacacuggcuaguccacaaagaaugguuucacgacauaccccucccauggcacgccggcgcagacaccggaacaccccauuggaacaacaaagaagcccuagucgaguucaaagacgcacacgcaaaacggcagacaguagucguacuaggcucccaggagggcgcaguacacaccgcacuggccggcgcccuggaagccgaaauggauggcgcaaaaggaaggcuguucucgggacaccucaaaugcaggcugaaaauggacaaacuaagacucaaagggguaucauacuccuuaugcacagccgccuucaccuucaccaaaguaccagcagagacgcuccacggcaccgugaccgucgagguacaauacgccggcaccgacggaccaugcaaaguccccgcccaaauggcaguagauaugcagacacugaccccagucggcagacuaauaaccgccaacccgguuauaaccgaaagcaccgaaaacucaaaaaugauguuggaacuggacccacccuucggcgauagcuacauagucauagguguaggagacaagaaaaucacccaccacuggcacagaucagguagcacaaucggcaaagcguucgaagccaccguccgcggcgcaaaaaggauggccguacucggcgacaccgccugggacuucggcagcgugggaggagucuucaacagccuaggaaaaggcauccaccaaaucuucggagccgccuucaaaagccucuucggaggaaugagcugguucucccaaauccucaucggaacccuacuggucuggcucggccucaacaccaaaaacggcagcaucucucuaaccugccucgcacuaggcggcgucaugauauuccucagcaccgcggucucagcaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9542 - RNA, 2278 nt, Artificial Sequence
  KU963573.2 prME-short mRNA Design 3 opt
gggagaaagcuuaccaugaccucaaucggaaucaucggacuauugcucaccaccgcgauggcagcagaaaucacacgcagaggauccgcauauuacauguaccuugaccgcagugacgccggcaaagcaaucucuuucgccacaacacucggagucaacaaaugccacguccaaaucauggaccucggccacaugugcgacgccacaauguccuacgaaugccccaugcucgacgaaggcgucgaacccgacgacgucgacugcuggugcaacaccacauccacuugggucgucuacggaaccugccaccacaagaaaggcgaggcgagacgcuccagacgcgccgucacacuacccucgcacuccacaaggaaacuccagacccgaagccagaccuggcuagagucccgggaauacaccaaacacuuaaucaaaguagagaacuggauauuuagaaaccccggauucgcucucgucgccgucgcaauugcuuggcuccuaggcucaagcaccagucaaaaaguuauuuaccuagucaugauacuacuaaucgcacccgccuacuccauccgcugcaucggagucaguaaccgcgacuucguggaaggcauguccggaggaacgugggucgacguaguccucgagcacggaggaugcgucacagucauggcacaggacaaaccaaccgucgacauagagcuagucaccacgacagucucaaacauggccgaaguaaggucuuacugcuacgaagccagcaucuccgauauggccucagacucccgaugccccacccaaggagaggccuaccucgacaaacaaucagacacccaauacguaugcaaaagaacccuaguugaccgcggcuggggaaacggcugcggccucuucggcaaagggagccuaguaaccugcgcaaaauucacaugcuccaagaaaaugaccggcaaauccauccaaccagaaaaccucgaguaccgcauaaugcucucaguacacggcucacaacacagcggaaugauaggcuacgaaaccgacgaaaaccgcgccaaagucgaagucacccccaacagcccacgcgccgaagccacacucggcggauucggcucccuaggccuagacugcgaaccccgcaccggucuugauuuuucagaccuuuauuaccucacaaugaacaacaaacacuggcucgugcauaaagaaugguuucacgauauaccacuaccguggcaugcgggagcagacaccggcacgccccacuggaacaacaaagaagcacucgucgaguucaaagacgcccaugccaaacgccaaaccguaguaguucuaggaucacaagaaggagcaguccacaccgcccucgccggagccuuagaagcagaaauggacggagcgaaaggcaaacuguucagcggccaccuaaagugcagacucaaaauggacaagcuccgccucaaaggcgucucauacucacuaugcaccgcagccuucaccuucaccaaggucccagcagaaacccuccacgggaccgucacugucgaaguccaguaugcaggcacggacggaccaugcaagaucccgguccagauggcaguagacaugcaaacccucacacccgucggccgacucaucacagcaaaccccgugaucacagaauccacugaaaacucaaaaaugaugcucgaacucgacccgcccuucggcgacagcuacaucgucaucggcgucggcgacaaaaagauaacccaccacuggcaccgcagcgggucaacuaucggcaaagcauucgaagccaccguccgcggcgccaaacgaauggccguacucggagacacggccugggauuucggcuccguaggcggaguauucaacagccuaggaaagggcauccaccaaaucuucggagcagcauucaaaagccuauucggcggcaugucaugguuuucccaaauacugaucggcacacucuuagucuggcucggacucaacaccaagaacggcuccaucagccuaaccugccucgcacuaggcggagucaugaucuuccuaagcaccgccguaagcgcaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9543 - RNA, 2290 nt, Artificial Sequence
  KX694534.2 prME-short mRNA Design 3 opt
gggagaaagcuuaccaugaccuccgucggaauagucggccucuuacuaaccacugccauggccgcagaaguaacccgccgagggagcgcauacuacauguaccucgaccgcaacgacgcaggagaagccaucagcuuccccacgacgcuaggcaugaacaagugcuacauacagaucauggaccuaggccauaugugcgacgccacaaugucauacgaaugcccaaugcuagacgaaggcgucgaacccgacgacgucgacugcuggugcaauacaacaagcacuuggguagucuacggaaccugccaccacaagaaaggggaagcacgacgaagccgccgagcagucacucuccccucacacagcacccggaaacuccaaacacgcagccaaaccuggcuagaaagccgagaauauacaaaacaccucauacgaguagaaaacuggaucuuccgaaacccaggcuucgcauuagccgccgcggccaucgccuggcuacugggcucgucaacaucacagaaaguuaucuaccuaguaaugauacuucuaaucgcccccgccuacagcauaagaugcaucggcguaagcaacagagacuucguagaggggaugagcggcgggaccuggguagacgucguccuggagcacggcgguugcgucacgguaauggcccaagacaaaccaaccguugacaucgaacucguaacgacgaccguguccaacauggcagaaguccgaucauacugcuacgaagccagcaucagcgacauggcauccgacucuagaugcccgacccagggagaagccuaccuugacaaacaaagugacacacaauacgucugcaaacgaacccucgucgaccgcggcuggggcaacggcugcggccucuucgggaaaggcagccuaguaaccugugcgaaauucgcaugcagcaagaaaaugacagggaaauccauacagccagaaaaccuagaauaccgcauaaugcugaguguccacggaucucaacacagcggcaugaucguaaacgacacaggacacgaaacagacgaaaaccgagcaaaaguagagaucaccccgaacagcccccgagcggaagcaacacuaggcggauucggcagccugggccucgacugugaacccagaacaggcuuagacuucagcgaccucuacuaccucaccaugaacaacaaacacuggcucguccauaaagaaugguuccacgacaucccgcucccauggcacgccggcgcagacacaggaacgccacacuggaacaacaaagaggcgcuaguggaguucaaagacgcacacgccaaacgccagaccguagucguacuaggaucacaagaaggcgccguucacacagcccuagccggagcacucgaagccgaaauggacggcgcaaagggcagacuaucaucaggccaccuaaaaugccgccuaaagauggacaaacugcgccuaaaaggcgugucauacucacuaugcacagcagcauucacguuuaccaagauaccagcagaaacacuacacgguacagucaccgucgaaguccaauacgcagggaccgacggaccaugcaaaguacccgcccaaauggcaguggacaugcaaacacucacaccgguaggacgacuuaucaccgccaacccgguaauaacagaauccaccgaaaacagcaaaaugaugcucgaacucgacccacccuucggagacuccuacauaguaauaggcgucggagaaaagaaaaucacacaccacuggcaccgcuccggcuccaccaucgggaaagcauucgaagccacagucagaggagccaaacgaauggcgguccugggcgacacggcaugggacuucggaagcgucgggggcgcacucaacucacucggccguggaauacaccaaaucuucggggccgcguucaaaagccucuucggcggcaugagcugguucucgcaaauccucauaggcacccuacucauguggcucggacuaaacaccaaaaacggaucaaucagccucaugugcuuagcccuaggcggcguccucauuuuucucagcaccgcgguaagcgcaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9544 - RNA, 2290 nt, Artificial Sequence
  KX369547.1 prME-short mRNA Design 3 opt
gggagaaagcuuaccaugaccuccguaggaaucguuggcuuacuccucaccaccgcaauggcagcagaaguaacucggcgcggcucagccuacuacauguaccucgaccgcaacgacgcaggagaagccauaagcuuccccaccacccuuggcaugaacaaaugcuacauccaaauaauggaccuuggucacaugugcgacgcgaccaugagcuacgaaugccccaugcuagacgaaggagucgaaccagacgacguagacugcuggugcaacaccacaagcaccugggucguauacggcaccugccaccacaaaaaaggcgaagccagacgcucacgacgagccgucacucuucccucccacuccacccgcaaacuacaaacgcgaucccaaaccugguuagaaagccgcgaauacaccaaacaccuuauaagggucgagaacuggauauuccgcaaucccggacuagcucuugcagccgcagcaauagccuggcuacuaggaucguccaccucacaaaaagucauauaccuagucaugauccuccuaauagcuccagccuacagcauacguugcaucggcguuuccaaccgggacuucguagaaggcaugagcggcggcaccugggucgacguuguacuggaacacggaggaugcgucaccgucauggcccaagacaaacccacugucgacaucgaacuaguaaccacaaccgucagcaacauggccgagguacgcagcuacugcuacgaggcguccaucagcgacauggcguccgacucacggugccccacccaaggcgaagcauaccuagacaaacaaucugacacccaauacguaugcaaacgaacccucguggaccgaggauggggcaacggcugcggccuguucggcaaaggcucacuagucaccugugcaaaauucgccugcuccaaaaaaaugacagggaaauccauacaacccgaaaaccuagaauauagaaucaugcuaagcgugcacgguucccagcauuccggcaugauaguaaacgacaccggccacgaaaccgacgaaaaccgugcaaaagucgaaauaacuccaaacucaccccgcgccgaagcaaccuuaggcggcuucggcucacucggccuagacugcgagccccgcaccggguuagacuucuccgaccuguacuaccuuaccaugaacaacaaacacuggcuaguacacaaagaaugguuccacgacauaccccuaccauggcacgcgggggccgacacaggaaccccccacuggaacaauaaagaagcccucgucgaauucaaagacgcccacgcuaagcgccaaaccguagucguccuagggucacaggagggagccguccacacugcccuagccggcgcucucgaagcagaaauggauggcgcaaaagggcgacuuagcuccggacaccuaaaaugucgccucaaaauggacaaauugcgacuuaaaggagucucuuacucucucugcaccgccgccuucacauucacaaaaaucccagccgaaacccuccacggcaccgucaccguagaaguccaauaugcaggcaccgacggacccugcaaagucccugcacaaauggccgucgacaugcaaacacucacaccaguaggccgacucauaacugccaacccgguaaucaccgaauccacugaaaacucgaaaaugaugcucgaacucgacccaccauucggagacucauacauagucauaggugucggagaaaaaaaaauaacccaucacuggcacagaucaggcucaaccaucggcaaggcauucgaagccaccguaaggggcgcaaaacgcauggccguccuaggagacaccgcaugggacuucggaucgguaggcggcgcacucaacagccuaggcaaaggcauacaccagauauucggcgcagccuuuaaaagccucuucggcggaaugucaugguucagccagauccucauaggcacacuccuuauguggcuaggccuaaacacaaaaaacggauccaucucccucaugugccucgcccucggaggaguacugaucuuccuaucgaccgcagucagcgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9545 - RNA, 2290 nt, Artificial Sequence
  KX447515.1 prME-short mRNA Design 3 opt
gggagaaagcuuaccaugacaagcguagguauagucggccuccuccucaccaccgcaauggcagccgaggucacacgcagaggcagcgcauacuacauguaccuagaccggaacgacgcaggagaagcaaucucguucccaaccacccuugggaugaacaaaugcuacauacagauaauggaccugggacauaugugcgacgccacaauguccuacgaaugcccaaugcucgacgaggggguagaacccgaugacguagacugcuggugcaacaccacaagcacaugggucgucuacggcacaugccaccacaagaaaggggaagcccggaggagcagacgagcagucacacuccccagccacagcacaagaaaacuacagacccgcucacaaaccuggcuagaaagccgagaguacacaaaacaccucauacgaguugaaaacuggaucuuccgcaaccccggauucgcgcuagccgcggcagcaauagcauggcuccugggaucuagcaccagucaaaaaguuaucuaccuugucaugauacuccuaauagcccccgcauacagcauacgaugcauaggcguaagcaaccgcgacuucgucgaagggaugucaggagggaccugggucgacguaguacuagaacacggcggaugcgugacagucauggcccaagacaaacccacaguagacauagagcucgucacaaccacaguauccaacauggccgaaguccgcucguacugcuacgaagcaucaaucagcgacauggccucagacucccgcugccccacgcagggagaagcauaccucgacaaacaaucagacacacaguacgucugcaaaaggacccuaguagaccgaggaugggggaacgggugcggacucuuuggaaagggaucgcucguaacaugcgcaaaauucgccugcagcaaaaagaugacaggcaaaucaauacagccggaaaaccucgaauaccggaucaugcucuccguacacggcucacaacacucgggcaugauagucaacgacacaggccacgaaacagacgaaaacagggccaaagucgaaaucaccccgaacucaccgcgcgcagaggcuacccuaggaggguucggaucccucggccuagacugcgaaccgcgaacaggacuggacuucagugaccucuacuaccuaaccaugaacaacaaacacuggcuaguccacaaagaaugguuccacgacauaccccuccccuggcacgcaggagccgauaccggcacgccgcacuggaacaacaaagaggcccuagucgaguucaaagacgcacacgcaaaaaggcaaacggucgucguacucggcucgcaagaaggagcaguacauacagcacuagcaggcgcacucgaggccgaaauggacggagccaaagggcgccuuuccagcggccaccucaaaugccggcuuaaaauggacaaacuuaggcuaaaaggggucuccuacagccucugcaccgccgccuucacauucacuaaaaucccagcagagacccuacacggaacagugaccguagaagugcaauacgccgggacagacggacccugcaaaguacccgcacaaauggccguugacaugcagacacuaacccccgucggacgacuaaucaccgccaauccggugauaaccgaaucgacugaaaacagcaaaaugaugcucgaacucgacccacccuucggcgacagcuacaucguaauaggagucggcgaaaagaaaauaacccaccacugguaccgcuccggaagcaccaucggcaaagcguucgaagccacggucagaggugcaaaacgcauggccguccuaggcgauacggccugggacuucggaagcguugggggagcacuaaacucacuaggcaaagggauacaccaaauauucggugccgcauucaaaucccuguucggaggaaugucaugguucucacaaauacuaauaggcacacuacuaauguggcugggccucaacaccaagaacggaagcauuucccuaaugugccucgcccucggcggcguacuaaucuuccuauccacagcaguaagcgcaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9546 - RNA, 2290 nt, Artificial Sequence
  KU729218.1 prME-short mRNA Design 3 opt
gggagaaagcuuaccaugacgucuguaggcauaguuggccuacuccucacaacagccauggcagccgaaguaacccgccgcggcucagccuauuacauguaccuggaccgaaacgacgcuggagaagccaucucauuccccaccacccucggaaugaacaaaugcuacauacaaaucauggaccucggacacaugugcgacgcgaccaugaguuacgaaugcccaauguuggacgaaggagucgagcccgacgacguugacugcugguguaacaccaccaguacuugggucgucuacggaaccugccaccacaagaaaggggaagcccgacgaucccgccgggcgguaacccuaccuucccacagcacccgcaaacuccaaacacgaucacaaaccuggcucgaaagcagagaauacacgaaacaucucauacgaguagagaacuggauauucagaaauccgggauucgcacuagccgccgccgccaucgccuggcuccugggaucaucaaccagccaaaaaguaauauaccucgugaugauccuccuaauagcccccgcguacucaauacgcugcauaggcgucagcaaccgggacuucguagaaggcauguccgggggcaccugggucgacguaguacucgagcacggcggcugcgugaccguaauggcccaagacaaacccaccguagacaucgaacugguuacaaccacagugucaaacauggcagaagucagaagcuacugcuacgaagccucgauaagcgacauggccuccgacagccgaugccccacccaaggagaagccuaccuagacaaacaaucagacacacaauacgucugcaaacgaacccuaguagaccgcggcuggggcaacggaugcggccuuuucggaaaaggcucacuuguaaccugcgccaaauucgcaugcagcaagaaaaugaccggaaaaucaauccaaccagaaaaccuagaguaucgcaucaugcucuccguacacggaucacaacacucaggcaugauagucaaugauacgggccacgaaaccgacgaaaauagagcaaaagucgagaucacccccaacagcccccgcgccgaagcaacacucggaggauucgggagccucggacucgacugcgaaccccgaacaggccuagacuucucagaccuauacuaccucaccaugaacaacaaacacuggcucguacacaaagaaugguuucacgacauaccacuacccuggcacgcuggggccgacaccgggacuccccacuggaauaacaaagaagcccuaguagaguucaaagacgcccacgccaaacgccaaacggucguaguacucggcagccaagaaggggccguccacaccgcgcucgccggagcccucgaagccgaaauggacggagcaaagggacggcuauccucagggcaccucaaaugcagacuaaagauggacaaacuccgucugaagggcguuuccuauagccucugcaccgcagcauucaccuucacaaagaucccggccgaaacacuccacgggaccgucaccguagaagugcaauacgccggcacagauggccccugcaaaguccccgcccagauggccgucgacacccaaacgcugacacccgucggccgccuaaucaccgcgaaucccgucauaacugaauccaccgaaaacucgaaaaugauguuagaacucgaucccccauucggggacucauacaucguaauaggcgucggagaaaagaaaauaacccaccacuggcaccgaucaggcagcaccauaggcaaagccuucgaagccacuguaaggggcgcaaaacgcauggcaguacuaggagacaccgcaugggacuuuggcucagucggcggagcccucaacucccuaggcaaaggaauacaccagauuuucggagcagcuuucaaaagccucuucggcggcaugagcugguucucccagauucuaauaggcacccugcucauguggcucggacugaacaccaaaaacggauccaucucccucaugugccuagcacugggcggcguccuaauauuccugucuaccgccguauccgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9547 - RNA, 2290 nt, Artificial Sequence
  KU501217.1 prME-short mRNA Design 3 opt
gggagaaagcuuaccaugacauccgugggcauagucggucuccuacuuaccacagcaauggcagccgaaguaacacgccgaggcucagcauacuacauguaccucgaccggaacgacgcaggcgaagcaauauccuucccaaccacacucggcaugaacaaaugcuacauccaaaucauggaccucggccacaugugcgacgccacaauguccuacgaaugccccaugcucgacgaagggguggaaccagacgacgucgacuguuggugcaacaccaccuccaccugggucgucuacgggaccugccaccacaagaaaggcgaagcccgccgaagcagacgcgcagucacacucccuucccacucaacccgcaaacugcaaacccgcucacaaaccuggcucgaaagccgcgaauacaccaaacaccuuauaagaguagaaaacuggaucuuccgaaacccaggcuucgcacucgccgcagccgccauagccuggcuacuugggagcuccacgucccaaaaaguaauauaccucguaaugauucuccuaauagcgccagccuacuccauccggugcauaggagucucaaacagagacuucgucgaagguaugucgggaggaaccugggucgacguaguacuagaacacgggggcugcgucacugucauggcacaagacaaaccgaccgucgacauagaacucguaacaaccaccgugucuaacauggccgaaauccgaagcuacugcuacgaagcaagcauaagcgacauggccuccgacucgcgaugcccaacccaaggagaagccuaccuugacaaacaaagugauacacaauacgucugcaagagaacauuaguagaccgaggaugggggaacggaugcggccuauucggcaaaggcucacucgucacgugcgccaaguucgcuugcuccaagaaaaugaccggcaaaagcauacaaccugaaaaccucgaauacagaauaaugcuauccguccacggcucccaacacagcggaaugaucgucaacgacacaggacacgaaacagacgaaaaccgcgccaaaguagaaaucacccccaacucaccccgagcagaagccacucucggcggcuucggcucccuaggacuagacugcgaaccccgaaccggccuggacuuuuccgaccucuacuaccugaccaugaauaacaaacacuggcuaguacacaaagaaugguuccacgacauacccuuacccuggcacgccggcgccgacaccggcacaccccacuggaacaacaaagaagcccuggucgaguucaaggacgcacacgcaaaacgucaaaccguaguaguccucggcucccaagaaggcgccguccacaccgcccuagcaggggcacuagaagcagaaauggacggggccaaaggaagacuauccagcggccaccucaaaugccgacucaaaauggacaaacucagacucaaaggaguaucauacagccuauguaccgcagcguucaccuucaccaaaaucccagccgaaacacuacacgggacaguaaccguagaaguacaauacgccggaacugacggacccugcaaaguacccgcacaaauggcuguggacaugcaaaccuuaaccccagugggcagacugaucacagccaaccccguaauaacggaaucgacggaaaacuccaaaaugaugcucgaacuagacccucccuucggcgacucauacaucgucaucggcgucggcgagaaaaagaucacccaccauuggcaccgaagcggcagcacgauaggcaaagcauucgaagcaacaguaagaggcgccaaacgaauggccguccuaggagacaccgcaugggacuucggcagcguaggaggcgcacuaaacucacucggaaaaggaauccaccaaaucuucggagcagccuucaaaucccuauucgggggcaugaguugguucucccaaauacucaucggcacccuacuuauguggcucggccuuaacaccaagaacggaagcauaagccugaugugccucgcccugggcggcguccucaucuuccuuucuaccgcaguaucagccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9548 - RNA, 2290 nt, Artificial Sequence
  KU312314.1 prME-short mRNA Design 3 opt
gggagaaagcuuaccaugaccagcgugggaaucgucggacuacuccuaacaaccgcgauggcugccgaaguaacccgacgcgggagcgccuacuacauguacuuagacagaaacgacgcaggggaagcaaucagcuucccuacaacgcucggaaugaacaaaugcuacauacaaauaauggaccucggacacaugugcgacgcaacaaugaguuacgaaugcccaaugcuagacgaaggcguagaaccagacgacguagacugcuggugcaacaccacgagcacguggguagucuacgguacgugucaccacaagaaaggcgaagcacgacgcuccaggagagccguaacgcucccgagccacucgacacgaaaacuccaaacacgcagccaaaccuggcuagaaucacgagaauacacgaagcaccuaauccgaguagaaaacuggauauuccgaaaccccggauucgcgcucgccgccgcggccaucgcauggcuccuugggagcagcacaagccaaaaagugauauaccuaguaaugauccuacucaucgccccagcauacaguauacgaugcaucggagugagcaaccgcgacuucguggaaggaauguccgggggcaccugggucgacgucguccuggaacacggcggaugcgucacggucauggcacaagacaaaccaacaguggacauagaacucgucaccaccacagucagcaacauggcagaaguccgcagcuacugcuacgaagccagcaucucagacauggccuccgacagcagaugccccacccaaggcgaagcguaccuagacaaacaguccgacacgcaauacgucugcaaacggacacucguagacagaggauggggaaacggcugcggccuguucggcaaaggcucccuagucaccugugcaaaguucgccugcagcaagaaaaugacaggcaaaucaauccagccggaaaaccucgaauacagaauaaugcucagcguccacggcucccaacauagcggcaugauaguaaacgacacgggccacgaaacagacgaaaaccgagccaaagucgaaauaacacccaacagcccccgcgcggaagccacacucggaggcuucgggucgcuaggacucgacugugaaccaagaacaggccuggacuucagcgaccucuacuaccucaccaugaacaacaaacacuggcuugugcauaaagaaugguuccacgacauaccacucccguggcaugccggagcagacaccggaacaccacacuggaacaacaaagaagcccuaguggaguucaaagacgcacacgcaaaacgacaaacaguagucguacuaggaucccaagaaggcgcuguacacaccgcacuagccggcgcacuagaagccgaaauggacggagcaaaaggacgccuauccucaggccaccucaagugcaggcuaaagauggacaaacuccgauuaaagggagucuccuacagccugugcaccgccgccuucaccuucaccaaaaucccagccgaaacacugcacgggaccgugacaguagaaguacaauacgccggcacagauggacccugcaaaguacuagcacaaauggccgucgacaugcaaacacuaaccccagucggccgccucauaacggcaaaccccgugaucacagaauccacagaaaacucgaaaaugaugcuagaacucgacccacccuucggcgacucauacauaguaaucggaguaggagaaaagaaaauaacccaccacuggcacagaagcggaagcacaauaggcaaagccuucgaagcaaccguccgaggagccaaaagaauggcagucuuaggcgacaccgcaugggacuucgggagcgugggcggagcacuaaacagcuugggaaaaggaauccaccaaauauucggagcagcguucaaaagccuguucggaggcaugaguugguucagucagauccucaucggcacacuccucauguggcuaggacuaaacaccaaaaacggcagcaucucacugaugugccucgcgcucggaggcguacugauauuccugagcaccgccguauccgcaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9549 - RNA, 2290 nt, Artificial Sequence
  KX446950.2 prME-short mRNA Design 3 opt
gggagaaagcuuaccaugaccucagucgggauugucggacuccuacucaccacagccauggcagccgaggugacccgacgaggaucagccuacuacauguaucucgaucgcaacgacgcaggcgaagccauaucguuccccacaacccucggcaugaacaaaugcuacauccaaaucauggacuuaggccauaugugcgacgccaccaugucauacgaaugccccacacuagacgaaggcgucgaacccgacgacgucgacugcuggugcaauaccaccuccacaugggucguauacggcacaugccaccacaagaaaggcgaagcccgccgaucccgcagagccguuaccuuaccaagccacuccacccgaaaacuccaaacgcggagccaaaccuggcuagaaagccgcgaauacacaaaacaccucauccgcgucgaaaacuggauauuccgcaacccaggauucgcccucgccgccgccgcaauagcauggcugcucggcuccagcacaucccaaaaagucaucuaccucguaaugauccuucucaucgcccccgccuacuccauccgcugcaucggcgucucaaaccgagacuucgucgaaggcaugucaggcggcaccugggucgacgucguccuggaacacggaggcugcguaaccgucauggcccaagacaaaccgacaguagacaucgagcuagugaccacaacagucagcaauauggccgaagucagaucuuacugcuaugaagcguccaucucugacauggccuccgacucacgcugucccacgcaaggggaagccuaccuggacaaacaaagcgacacgcaguacgucuguaaacgcacccuagucgaccgcggcuggggcaacggaugcggacuauuuggaaaaggcucacucgucacuugcgccaaauucgccugcucaaagaagaugaccggaaagucuauccaaccggaaaaccuagaauaccgcauaaugcuauccguccacgggucacaacacucaggaaugauagucaaugacaccggacacgaaaccgacgaaaaccgugcuaaaguagaaaucacccccaacuccccuagagccgaagcaacccuagggggauucggaagucuaggccuggacugcgaaccacgcaccggccuggacuucuccgaccucuacuaccucacaaugaacaacaagcacuggcuaguccacaaagaaugguuccacgacaucccacuaccuuggcacgccggcgccgacacaggcacaccccacuggaacaacaaagaagcccucguagaguucaaagacgcucacgccaaacgucaaaccgucgucguccuagggagccaagaaggcgcaguccacaccgcguuggcaggcgcccuagaagcagaaauggacggagcaaaaggacgacucuccucgggccaccuaaaaugccggcuaaaaauggacaaacuacgccucaaaggcgucuccuacagccucugcaccgcagccuucaccuucaccaagaucccagccgaaacccuucacggcaccguaaccguagaaguccaauacgcaggcacagacggcccaugcaaaguaccagcccaaauggcaguagauaugcaaacacuaaccccuguuggccgccucaucacagccaaccccguaaucaccgaaagcaccgagaacucaaaaaugaugcuagagcucgacccacccuuuggcgauuccuacaucgucaucgggguaggcgaaaagaaaaucacgcaccacuggcacagguccggaagcacaaucggcaaagcguucgaggcaacuguccgaggcgccaaacgaauggcaguccucggugacaccgccugggauuucggaagcgucggcggugcccucaauagccuaggcaagggcauccaccaaaucuucggcgccgccuucaaaucccuguucggaggcaugucaugguucucacagauccuaauaggcacccugcuaauguggcuaggccucaacaccaaaaacggaucgaucuccuuaaugugccuagcacucggcgggguccuaaucuuccuauccacagccguaucagccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9550 - RNA, 2290 nt, Artificial Sequence
  KY003157.1 prME-short mRNA Design 3 opt
gggagaaagcuuaccaugaccucgguagggaucgucggccuacuccuaacaacagccauggccgccgaagucacccgccgaggaagugccuacuacauguacuuagaccgaaacgacgccggggaggccauaucguuccccacaacacuaggaaugaacaaaugcuacauucagauaauggaccuaggacacaugugugacgcaaccaugaguuacgaaugucccaugcuggacgaaggaguagagcccgacgacguagacugcuggugcaacacaaccagcacuuggguagucuacggaacgugucaucacaagaaaggcgaagcacgacgaucccgaagggcuguaacgcugccaucacacucgacccgaaaacuucaaacacgaucgcaaacauggcuagagucccgcgaauacacaaaacaccucauacgcgucgaaaacuggauauuccgcaaccccggcuucgcccuggccgcagccgccaucgcauggcuccucggcagcaguaccucccaaaaagucaucuaccucguaaugauccuacuaaucgccccagcauacagcauacgaugcaucggaguaucaaaccgcgacuucgucgaaggcaugagcggcggaacauggguagacguaguauuagaacacggaggcugcguaacuguaauggcgcaagacaaaccgacaguagacaucgagcuagucaccaccaccgucaguaacauggcagaaguccggucauacugcuacgaagccagcauaucagacauggcguccgacagccggugccccacccagggcgaagccuaccuagacaaacaauccgacacccaauacgugugcaaaagaacccuaguagacagaggauggggcaacggaugcggccuauucgggaaagggucgcucguaacaugcgcaaaauucgccugcucaaagaaaaugacagggaaaucaauccaaccagaaaaccuagaauacagaaucaugcuaucuguccacggcucccagcacagcggcaugauagucaacgacacaggccacgaaaccgacgaaaacagggccaaaguagaaaucacaccaaacuccccacgcgccgaagcaacauuaggcggcuucggcagccuaggccucgacugcgagccccgaacgggccuugacuucuccgaccuauacuaccucaccaugaacaacaaacacuggcuuguacacaaagagugguuccacgacauaccccuacccuggcacgcaggcgccgacacaggcacaccccacuggaacaacaaagaagcccuggucgaguucaaagacgcacacgcaaaacgccaaacaguaguuguacucggaagccaggaaggcgcuguacacacagcccucgcaggagcucuggaagccgaaauggacggugcaaaaggccgacucucaagcggccaccugaaaugcagacuaaaaauggacaaacucagacucaaaggggugagcuacagccucugcacagccgcauucacauucacaaaaauaccagccgaaacccuucacgguacagucacaguggagguccaauacgcaggaacggacggaccaugcaaagugcccgcccaaauggcagucgacaugcaaacccucacgcccguagggaggcucauaacagcuaaccccguaauaacagagagcacggaaaacagcaaaaugaugcucgagcucgacccgcccuuuggggacagcuacauagucaucggcguaggagaaaagaaaaucacacaucacuggcaccgaagcggcucaacaauaggcaaagcguucgaagcaacaguacgaggcgccaaaagaauggcugugcucggagacaccgccugggacuucgguuccguaggcggagcacucaacucucugggcaaaggcauacaccaaaucuucggagcagccuucaaaucccucuucggaggaaugucaugguucagccaaauccucauaggaacacugcucauguggcucggacuaaacaccaaaaacggcagcauaucccuaaugugccuggcacuaggaggcguccuaauauuccucucuaccgugguaucagccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9551 - RNA, 2290 nt, Artificial Sequence
  KX811222.1 prME-short mRNA Design 3 opt
gggagaaagcuuaccaugaccagcguaggcaucgucgggcuacuacuaacaaccgcgauggccgccgaagucacacgcagaggguccgccuauuacauguaccuagacaggaacgacgccggcgaagcaauaucauucccgaccacgcuggggaugaacaaaugcuacauacagauaauggaccucgggcacaugugcgacgcaacaaugaguuacgaaugccccaugcuggacgaaggcguagaaccggacgacgucgacugcuggugcaacacaacgagugcauggguggucuacggaaccugccaccacaagaaaggcgaagcgcgcagaagccgccgagcagucacacuaccaagccacaguacacguaagcuccaaacaagaccacaaacauggcucgagucccgagaguacacaaaacacuuaauacgaguagagaacuggaucuucagaaacccaggauucgcacucgcagccgcagcaaucgcauggcuacuggguuccagcaccagccaaaaagucaucuaccucguaaugauacuccuaaucgccccggccuacuccaucaggugcaucggaguaagcaaccgcgauuucgucgaagggaugucgggaggaaccuggguagacgucguacucgaacacggcggcugugucacgguaauggcccaagacaaaccaacuguagacaucgagcuaguaaccacgaccguaucaaacauggccgaagucagaagcuacugcuacgaagcaucaaucagcgacauggccuccgacagcagaugccccacccaaggcgaagccuaccuggacaaacaaagcgacacacaauacguaugcaagagaacacuggucgaccgaggauggggcaacggcugcggccucuucgguaaagggucgcuaguuacaugcgccaaauucgcgugcagcaagaaaaugaccggaaaaagcauccaaccagaaaaccucgaauacagaaucaugcuauccguacacggcagccagcacagcggcaugauaguaaacgacaccgggcacgaaacagacgaaaacagggcaaaagucgagauaacacccaacucuccacgagccgaagcaacccucggaggauucgggagccucggacuagacugugaaccgaggaccggccuagacuucagcgaccuguacuacuuaacaaugaauaacaaacacuggcuuguacacaaagagugguuccacgacaucccccuaccauggcacgccggcgcagacaccggaacgccgcacuggaacaauaaagaggcccuaguagaguucaaagacgcccacgcaaaacgacaaacuguagucguccuaggcucacaagagggagcaguccauaccgcccuagccggagcgcucgaagcagagauggacggagcgaaagggcgccuaucaagcggacaccuaaagugcaggcuaaaaauggauaaacugcgccucaagggcgucagcuacucacucugcacagcagcauucacauucacaaaaaucccggccgaaacccuacacggaaccguaacaguagaaguacaguacgcaggaaccgacggacccugcaaagucccggcccaaauggcgguugacaugcaaacccuaacgcccguaggacgccugaucacagccaaccccguaaucacagaaucaaccgaaaauucaaagaugaugcuggaacuggacccgccauucggagacagcuacaucguaauaggggucggcgaaaagaaaauaacacaccacuggcaccgauccggaagcaccauuggaaaagcauucgaggccacagucaggggagcgaaacgaauggcaguccucggggauacagcaugggacuucggauccguaggcggagcccugaacucacugggcaaaggaauccaccaaauauucggagcagcguucaaaucacuauucggaggcaugagcugguucucacaaauacuaauaggcacacuacuaauguggcucggccuaaacacgaaaaacggcagcaucucccuaaugugccuggcccuaggaggcguacuaauauuccuaucaacagccguuuccgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9552 - RNA, 2290 nt, Artificial Sequence
  KX447516.1 prME-short mRNA Design 3 opt
gggagaaagcuuaccaugacaucagucggaaucgucggccucuugcuuacaacagccauggccgcggagguaacacgccggggcagcgccuacuacauguaccuagacagaaacgacgccggcgaagcaaucagcuuccccaccacacucgguaugaacaaaugcuacauccaaaucauggaccucggccacaugugcgacgccaccauguccuacgaaugccccaugcuagacgaaggcgucgaacccgacgacguagacugcuggugcaacaccaccagcacauggguggucuacggaaccugccaccacaagaaaggagaagcccgaaggagccgccgcgcagucacccuacccagccacucaacaagaaaacugcagacacgaagccaaacauggcuagaaucccgcgaauacacaaaacaccuaaucagagucgaaaacuggaucuucagaaauccaggcuucgcacucgccgcugcagcaauagcguggcuacucggcagcucaacaucaaagaaaguaaucuaccuaguaaugauccuacugauagcaccagccuacagcaucagaugcaucgggguauccaacagagacuucgucgaaggcaugagcggagggacguggguagacgucguccucgaacacggcggaugcgucaccguaauggcacaagacaaaccaacagucgacauagaacucguaaccacaaccgucucgaacauggccgaaguccgaagcuacugcuacgaagcgagcaucagcgacauggcaucagacucacggugcccaacccaaggagaagcauaccuagacaaacagagcgacacccaauacgucuguaaaagaacccucgucgaccgcggauggggcaacggcugcggccuauucggaaaaggaucacucguaaccugcgccaaauucgccugcuccaagaaaaugacaggaaaaaguauucagcccgaaaaccuugaguaccgcaucaugcugucgguccacggaagucaacacagcggcaugaucguaaacgacacuggacacgagaccgacgaaaaucgagcaaaagucgaaauaacaccgaacucaccccgcgccgaagccacccuuggcggauucggaucccucggccuagacugcgaacccagaaccggccuagacuucucggaccucuauuaucucacgaugaacaacaaacacuggcuuguccacaaagaaugguuccacgacauuccacuacccuggcacgcaggagcagacaccggcaccccacacuggaacaacaaagaagcccuaguggaguucaaagacgcccacgccaaacgccagacaguaguaguccuaggcucccaagaaggagccguccacacagcccuggccggcgcacuagaagccgaaauggacggggcgaaagggcgccuuaguagcgggcaucuuaaaugccgccuaaaaauggacaaacucagacucaaaggagucagcuauucccucugcacugcagcauucaccuucacuaaaaucccagccgaaacccuacacggcaccguaaccguggaaguacaauacgcgggcacagacggcccaugcaaaguacccgcccaaauggccguagacaugcaaacccucacaccagugggcaggcucauaacagccaaccccgucaucacggaaucgaccgagaacaguaaaaugaugcuggaauuagacccgcccuucggagauagcuacaucguaaucggaguaggagagaagaaaaucacacaccacuggcaccgaucaggcagcacaaucggcaaggcuuucgaggccaccguaagaggcgcgaaacgcauggcaguacuaggcgacacagccugggacuucggcucaguuggaggcgcccuaaacagccuaggcaaaggcauccaccaaaucuucggcgccgcauuuaaaagccuauucggcggaauguccugguucagccagauccugaucggaacucuccuaauguggcugggguuaaacaccaaaaacgggucgaucucacuaaugugccucgcacuaggcggaguacuaaucuuccugagcacagcagucagcgcaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9553 - RNA, 2290 nt, Artificial Sequence
  KX520666.1 prME-short mRNA Design 3 opt
gggagaaagcuuaccaugacauccgucgggaucgucggccuccuacugacaaccgcuauggccgccgaagucacacgcagaggauccgcuuauuacauguaccucgaccgaaacgacgcaggcgaagcgaucaguuuccccacaacccucggaaugaacaaaugcuacauacaaaucauggaccucggacacaugugcgaugcgacgauguccuacgaaugccccauguuagacgaaggcgucgaacccgacgauguagacugcuggugcaacacaaccagcaccuggguaguauacggcacaugccaccacaagaaaggagaggcccgcagaucacgcagagcagucacacuacccagucacagcacgagaaaacuccaaacaaggagccagacauggcucgagagccgggaauacacaaaacaccuaauacgaguagaaaacuggaucuuccgaaacccaggauucgcgcucgccgccgccgccaucgccuggcuccucggcagcagcaccagacagaaaguaauauaccucgucaugauccuccuaauagcaccagcauauucaauacgaugcaucgggguaagcaaccgcgacuucguugaagggauguccggcggaacauggguagaugucguccuugaacacggcggcugcguaaccguaauggcccaagacaaacccacgguagacauagagcucguuacaacaaccguauccaacauggccgaagucaggagcuacugcuacgaggccagcauauccgacauggccagcgacagcagaugucccacacaaggagaagcguaccucgacaaacaaagcgacacacaauacguaugcaaacgaacccuagucgacagaggcuggggaaacggaugcggccucuucggcaagggcucccucguaaccugugcaaaguucgccugcuccaagaagaugaccggcaaaagcauacaacccgaaaaccuagaauaucgaaucaugcuaagcguacacgggagccaacacucaggcaugaucgucaaugacacaggccacgaaacagacgaaaacagggccaagguagaaaucacccccaacagcccccgcgccgaagccacccugggcggauucggcagccuaggccuagacugcgaacccagaacaggacuagacuucuccgaccucuacuaccucacaaugaacaauaaacauuggcugguacacaaggaaugguuccacgacauaccccucccuuggcacgccggagcagacaccggaacuccacacuggaacaacaaagaagcccuaguggaguucaaggacgcacacgcaaagagacaaacggucguaguacugggaucacaagaaggcgcaguccacaccgcccucgcgggagcacuagaagccgaaauggacggcgcaaaaggccgacuauccagcgggcaccuaaaaugcagacuaaaaauggacaaacuccgacuaaaaggagucaguuacagccuaugcaccgccgcauucacguucacaaaaaucccggccgagacgcugcacggcaccgucacgguugaagugcaauacgccggcacagacggccccugcaagguucccgcccaaauggccguagacaugcaaacgcuaaccccagucggccgccuuauaacggccaaccccguaaucaccgaaucaacagaaaacuccaaaaugaugcucgaacuagacccaccauucggcgacagcuacaucguaaucggcgucggcgaaaagaaaauaacgcaccacuggcaucgcagcggaagcacaaucggcaaagcguucgaagccaccguacgcggagccaaacgcauggccgugcucggcgacacagccugggacuucggaucagucggcggagcccuaaacagccucggcaaaggcauacaccaaauauuuggagcggccuucaaaucccuauucggagggaugagcugguucucccaaauccugaucggaacccuccucauguggcucggacucaacacgaaaaacggcagcauaagccuaaugugccuggccuugggcgguguacucauauuucuaagcaccgccgucagcgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9554 - RNA, 2290 nt, Artificial Sequence
  KU497555.1 prME-short mRNA Design 3 opt
gggagaaagcuuaccaugaccaguguagggauaguaggccuacuccucacaacggccauggcagcagaagucacccguagaggaagcgccuauuacauguaccuagaccgaaacgaugcgggcgaggccaucagcuucccaaccacucuaggcaugaauaaaugcuacauacaaaucauggaccucggacauaugugcgacgcgacaaugaguuacgaaugccccaugcuagacgagggcguagaaccagacgacguggacugcuggugcaauacaaccuccacaugggucgucuacggaacaugccaccacaagaaaggcgaggcccgacgcucgcgccgcgcuguaacauuacccucgcacuccacccgaaaacuccaaacacggagccaaacguggcucgaaagcagagaauacacaaaacacuuaauaagaguagaaaacuggauauuucgaaaccccggcuucgcccuagccgcggcagcgaucgcauggcuccuuggaagcagcacaagccagaaagucauauaccuagugaugauccuccucaucgcgcccgcauacucaauccggugcauaggcgucagcaacagagacuucguagaaggaaugagcggcggcaccugggucgacguagugcucgagcacggcggaugcgucaccguaauggcacaggacaaaccaaccgucgacaucgaacucgucacaaccacggucucaaacauggccgaagucagaucguacugcuacgaggccuccaucagcgacauggccagugacuccagaugccccacgcaaggggaagccuaccucgacaaacaaucagacacacaauacguaugcaaacgaacacucgucgacaggggauggggaaacggcugcggccucuucgguaaaggaucgcugguaaccugcgccaaauucgccugcagcaagaaaaugaccgggaaaagcauccaaccugaaaaccuagaauaccgcauaaugcucucaguccacgggucccagcacagcggcaugauagucaacgacacaggccacgaaaccgacgaaaacagggccaaaguagaaaucacccccaacagcccacgcgccgaagcaacgcuaggcggcuuuggaucccucggacuagacugugaaccacgaaccggccucgacuucuccgaccuauacuaucucaccaugaauaacaagcacuggcucgugcacaaagaaugguuccacgacaucccacucccauggcacgccggcgccgacaccggaacgccacauuggaacaacaaagaagcccuaguggaguucaaagacgcacacgcaaaaaggcaaacagucgucguacucggaacucaagaaggagcaguccacacagcgcucgcaggagcacucgaagcagaaauggacggggcaaagggcagacuauccagcggacaccucaagugccggcucaagauggacaaacuacgccuaaaaggcguaagcuacagccuaugcaccgcagccuucaccuucaccaagauacccgcagaaacccuacacggcacagucacaguggaaguccaauacgccggcaccgacggacccugcaaaguccccgcccaaauggcagucgacaugcagacgcucacacccguaggacguuuaaucacagcgaaccccguaauaaccgagucaaccgaaaacagcaaaaugaugcuagaacucgacccaccauucggcgacaguuacauagucaucggcguaggcgagaaaaagauaacccaccacuggcaccgaagcgggagcacaauaggcaaagccuucgaagcaaccguccgaggagccaaaagaauggccguccuaggagacaccgccugggauuucgggagcgucggcggggcacucaacagccucggaaaaggcauacaccaaauauucggggcagcauucaagagcuuguuuggagggaugucaugguucucccagauccucaucggcacccuacucauguggcuaggacuaaacaccaaaaacgggucgaucucacucaugugccuagcccucgggggcguacuuaucuuccuaucaacagcaguaagcgcaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9555 - RNA, 2290 nt, Artificial Sequence
  KY075939.1 prME-short mRNA Design 3 opt
gggagaaagcuuaccaugacgagcgucggcaucguaggacuacuccucacuaccgccauggcagccgaagucacaagacgaggauccgccuacuacauguaccuagaccgcaacgacgcaggcgaagcaauauccuucccaaccacgcuggguaugaacaaaugcuacauacaaauaauggaccucggacacaugugcgacgcaacaaugucguacgaaugcccgaugcuagacgaaggaguagagccagacgacgucgacugcuggugcaacacaaccuccacgugggucguguacggcacaugccaccacaaaaagggagaggcccgaagaagccgacgagccguaacccuccccucacacucgacccgcaaacuucagacacgcagccaaacauggcuagaaagcagagaauacaccaagcaccugaucaggguagaaaauuggauauuccgcaaccccggauuugcccuagcagccgcagccaucgcauggcuccugggauccagcacaucacagaaaguaauauaccuuguaaugauccuacuaaucgcaccagccuacucccuccggugcauaggcgucagcaaccgcgacuucgucgaaggcaugucaggcgggaccuggguagacguaguacucgaacaugggggaugcgucaccguaauggcacaggacaaaccaaccgucgacaucgagcugguaaccacaacaguaagcaacauggcagaagugcgcucauacugcuacgaagcauccaucagcgacauggccagcgacucccgcugcccaacacaaggcgaagccuaccuagacaaacaaagcgacacccaauacgucugcaagagaacccucguagaccgaggcugggguaacggcugcggacucuucggcaaaggcucacucgugacuugcgccaaguucgcaugcagcaagaaaaugacaggcaaaagcauacaaccagaaaaccuagaauacagaaucaugcucagcguucacggaucccaacacuccgggaugaucgucaacgacacaggccacgaaacagacgaaaaccgcgcaaaagucgaaaucacaccaaacagcccacgcgcagaagcaacacuuggcggauucggcagccucgggcuagacugcgaaccccgaacgggccuggacuucagcgaccuauacuaccuaaccaugaacaacaaacacuggcuaguccacaaagaaugguuccacgacaucccccucccauggcacgccggagccgacacaggaacaccccacuggaacaauaaagaagcccuaguagaguucaaagacgcccacgccaaacgccaaacaguaguaguucuagggagccaagaaggagcaguccacacagcgcucgcaggcgcccuggaggcagaaauggacggagccaaaggacggcucuccagcggacaccuuaagugccggcuaaaaauggacaaacucagacucaaaggcguaucuuacaguuuauguaccgccgccuuuacauucaccaagauccccgcugaaacacuucacgggaccgucacagucgaaguccaauacgcggguaccgacggaccaugcaagguccccgcgcaaauggcaguagacaugcagacauuaacacccguaggccggcuuaucacagcaaacccaguaaucacagaaucaacagaaaacucaaaaaugaugcucgagcuagacccgcccuucggggacucauacaucgucaucggagucggagagaaaaagaucacacaccacuggcaccgcagcggcagcacgaucggaaaagcguucgaagccacugugcgcggagcgaaaagaauggcaguacugggagacacugcgugggacuucggcucagucggaggggcacuaaacagccugggcaaaggaauacaccaaauauucggcgcggcauucaaaucccucuucggaggaaugaguugguucucacaaauccugaucggcacccuacucauguggcugggucucaacaccaaaaacgggucaauaagccucaugugccucgcacuaggcggaguacuaaucuuccucaguacagcaguaagcgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9556 - RNA, 2290 nt, Artificial Sequence
  KY075932.1 prME-short mRNA Design 3 opt
gggagaaagcuuaccaugaccuccgucgggauaguaggccuacuacucaccaccgcuauggcagcagaaguaacccgaaggggcagcgcauauuacauguaccuagacagaaacgacgccggcgaagcgaucaguuucccgacaacgcugggaaugaacaaaugcuacauacaaaucauggaccucggacacaugugugacgccaccaugucauacgaaugcccgaugcucgacgagggagucgaacccgaugauguagacugcuggugcaacacaacaagcacuugggucgucuacgggaccugccaccacaagaaaggcgaagcacgucgcagccgcagagcuguaacccucccaucgcacagcacacgcaaacuccaaacccgcucccaaacguggcuggaaucccgcgaguacaccaaacacuuaaucagaaucgaaaauuggaucuuccgcaaccccggcuucgcacucgcggcagccgccauagcguggcuccuaggcucauccacgagucaaaaaguaauauaccucgucaugauccuacuaauagcccccgccuacuccauacgcugcauaggcgucagcaaccgagacuucguagaaggaaugucuggaggcaccugggucgacguaguacuggaacacggcggcugcgucacggugauggcacaagacaaaccgaccguagacaucgaacucgucaccaccacaguaagcaacauggcugagguccgcucguacugcuacgaggcaagcauaagcgacauggcaucagacuccaggugccccacccaaggagaagccuaccucgacaaacaaagcgacacccaauauguaugcaaaaggacccuagucgaccgcggguggggaaacggcugcggacuauucggcaaaggaagccucguuaccugcgcaaaauucgcaugcuccaagaaaaugaccggcaaaucuauacaaccagaaaaccucgaauacagaauaaugcuaucaguccacggcucacaacacagcggcaugaucgucaaugacaccggccacgaaaccgacgaaaacagagcaaaaguagaaaucacccccaacagcccacgagccgaggccacccucggcggcuucggaucgcuggggcuagacugcgaacccagaacaggccucgacuucucugaccuauacuaccuaacgaugaacaacaaacacuggcucguccacaaagaaugguuccacgacaucccacuaccauggcacgcaggcgcagacacaggaacaccccacuggaauaauaaagaggcacuugucgaguucaaagacgcacacgccaaaagacaaaccgucguaguccucggcagccaagaaggugcuguacacaccgcacucgccggcgcccucgaagcagaaauggacggcgcaaaaggccgccuaucaucaggccaccuaaaaugccgccucaaaauggacaaacuccgacuaaaaggcgucagcuacucgcucugcaccgcggccuucaccuucaccaaaauccccgcagaaacccuacacggaaccgugaccgucgaaguccaauacgcaggaaccgacggaccaugcaaagucccagcacaaauggccgucgacaugcagacacuaacaccaguaggcagacucauaacugccaacccaguaaucacagaauccaccgaaaacaguaaaaugaugcucgaacuagacccgccauucggcgacagcuacaucgucaucggcgucggggaaaagaaaaucacacaucacuggcaccgcucaggauccacaaucggcaaagccuucgaagccacaguccgaggggcuaaaagaauggcaguccucggcgacaccgcaugggacuucggcagcguaggcggcgcccuaaacucacucggaaaaggcauucaccaaauauucggcgcagcauucaaaucacuuuucggaggaaugagcugguucucacaaauacuaaucggaacacuacuaauguggcucggacucaacaccaaaaacggguccauaagccugaugugucuagcccuaggaggaguacucaucuuccuaagcaccgcagucuccgcaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9557 - RNA, 2290 nt, Artificial Sequence
  KU870645.1 prME-short mRNA Design 3 opt
gggagaaagcuuaccaugacaucagugggaauaguaggacuccuacuaacgaccgcaauggccgcagaaguuacccgaagaggcagcgcauacuauauguaccucgaccgcaacgacgccggcgaagccaucucauucccaaccacacucgggaugaacaaaugcuacauccaaauaauggaccuaggacacaugugcgacgcgaccaugucauacgagugucccaugcuugacgaaggcguagaaccggacgacguagacugcuggugcaacaccacgagcaccugggugguauacggcaccugccaccacaaaaaaggcgaggcgagaaggagcagacgagccgucacccuucccagccauucaacccgaaaacuacaaacaagaagucaaacguggcuagaaucacgcgaauacacaaaacaccugauccgcguagaaaacuggauccuaaggaacccaggauucgcacuggccgccgcggccaucgccuggcuccuagggagcagcacaucccaaaaaguaaucuaccuagucaugauccuccugauagcgcccgcguacagcaucagauguaucggcgucuccaaccgagacuucguagaaggaaugucuggggguacaugggucgacgucguccuagaacacggcggcugcgucacaguaauggcacaagacaaaccaacgguagacauagaacucgugaccaccaccgucucaaacauggcagaaguacgaucguacugcuacgaggcguccauaucagacauggccagcgacagccgcugcccaacccagggagaggcauaccucgacaaacaauccgacacccaauacgugugcaaaaggacacuagucgaccgggggugggggaacggcugcggccucuuuggaaaaggcagccucgucacaugcgccaaauucgccugcuccaaaaaaaugacagggaaaagcauccaaccagaaaaccuagaauaccgaaucaugcucuccgugcacggcucacaacacuccgggaugauaguaaacgacacaggacacgagaccgacgaaaaccgagccaaaguugaaauaacccccaacagccccagagcugaagccacacuuggaggauucggaucccuaggccucgacugcgaaccacgcacgggccucgacuuuagcgaccuauacuaccuaaccaugaacaacaaacacuggcugguccacaaagaaugguuccacgacaucccgcugccauggcacgccggcgccgacacgggaaccccccacuggaacaacaaagaggcacucgucgaauuuaaagacgcacacgccaaacgacaaaccgucguuguacuaggcucacaagagggcgcgguccauacagcacuagcaggcgcccuggaggccgaaauggacggagccaaaggccgacucuccagcggacaucuaaaaugccgacugaagauggauaaacuacgacucaaaggagucucauacucacuauguaccgcagcauuuacauucacaaaaauacccgcagaaacacuacacggaaccguaaccgucgaaguccaguacgccggcacggacggccccugcaaaguccccgcccaaauggccgucgacaugcaaacacugaccccagucggccgccucauaaccgcaaacccagucaucacugaauccaccgagaacagcaaaaugaugcucgagcucgacccccccuucggcgacagcuacaucgucaucggcaucggggaaaagaaaauaacacaccacuggcaccgauccggcagcaccaucggcaaagccuucgaggcaacaguccgcggagcaaaacgcauggcaguccucggagacaccgccugggacuucggcagcgucggaggagcccucaacucucugggcaaagggauacaccaaaucuucggagcagcauucaaaagccuauucggcggaaugagcugguucucccaaauacucauaggaacccuccucauguggcucggacuaaacaccaaaaacggauccauaagccuaaugugccuagcucucggaggcgugcuaauauucuuaaguaccgccgucagcgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9558 - RNA, 2290 nt, Artificial Sequence
  KU729217.2 prME-short mRNA Design 3 opt
gggagaaagcuuaccaugaccuccguaggaaucgucggccuccugcuaaccaccgccauggcagccgaagucacacgccgcggcucagcauacuacauguaucucgacagaaaugacgccggugaagccauaucauuccccaccacacugggcaugaauaagugcuacauccaaaucauggaccugggccacaugugcgacgccacaauguccuacgaaugucccaugcucgacgaaggcgucgagcccgacgacguagacugcuggugcaacaccacuagcacgugggucgucuacggaaccugccaccacaagaaaggcgaagcccgccgaucaagaagggcagucacccuucccucacacagcacccgaaaauuacaaacaagaagccaaacauggcucgaaagccgcgaauacacaaaacaccuuauccgcguagagaacuggaucuuccgcaaccccggcuucgcccucgccgccgccgccaucgccuggcuacuuggcucauccaccagccaaaaagucaucuaccuagucaugauccuacucaucgcacccgccuacuccauccgaugcaucggcguauccaaccgcgacuucgucgaaggaaugaguggcggcaccuggguagacguuguccucgaacacggcggaugcguaaccgucauggcccaagacaaaccgaccgucgacauagaacucgucucaaccaccguaagcaacauggcagaaguaagaucauacugcuacgaagcaaccauaagcgacauugcgucggacucccgcugcccaacucagggcgaagccuaccuagacaaacaaucagacacccaauacgugugcaaacgaacccucguggauagaggcuggggcaaugggugcgggcuuuucgggaaaggcucccuggucacaugcgccaaauucgccuguagcaagaaaaugacaggcaaauccauccaaccggaaaaccucgaauaccgcaucaugcuaucaguacacggcagccaacacagcggcaugauuguaaacgacacaggacacgaaaccgaugaaaaccgagccaaagucgaaauuacccccaacucaccccgcgccgaggcaacccuuggaggcuucggcucccucggacuggacugcgaaccaagaacaggccucgacuuuuccgaccucuacuaccuaaccaugaacaacaaacacuggcucguacacaaggaaugguuccacgacaucccccuucccuggcacgcgggagcggacaccggcaccccacacuggaacaacaaagaagcgcuggucgaguucaaagacgcccaugccaaacgccaaacagccgucgugcucgggagccaagaaggagcaguucacaccgcccuagccggcgcccuggaagcagaaauggacggcgccaaagggcgacucuccuccggccaccucaaaugccgacuaaagauggacaaauuacgccuaaaaggagucuccuauagccuaugcacagccgcauucacauucacaaagauacccgcagaaacccuccacggcaccguaaccgucgaaguacaauacgcaggaacggacggaccaugcaaaguacccgcccaaauggcagucgacaugcaaacccuaacccccgucggacgacucauaaccgccaacccagucaucacagaaagcaccgaaaacucaaaaaugaugcucgaacucgacccacccuucggcgacucauacaucgucaucggcgucggagaaaagaaaauaacccaccacuggcaccgcuccggcagcacgaucgggaaagcauucgaagccacaguccgaggagccaagcgaauggcaguccuaggcgauacagccugggacuucggcucaguagguggcgcccuaaacucacucggaaagggaauccaccaaauauuuggcgccgcauucaaaucccuauucggcggcauguccugguucagccagauauuaauaggaacacuacucauguggcuagggcucaauaccaaaaacggcuccaucucgcuaaugugccuagcccucgguggcguacucaucuuccucagcaccgcagucuccgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9559 - RNA, 2290 nt, Artificial Sequence
  KX087101.3 prME-short mRNA Design 3 opt
gggagaaagcuuaccaugacaagcguuggaaucguaggacuacuacugaccaccgccauggcugccgaagucacacgccgaggcucagccuacuacauguaccucgaccgaaacgacgccggugaagcaauaucauucccaaccacacucggcaugaacaaaugcuacauccaaaucauggaccucggacacaugugcgacgccaccaugagcuacgaaugucccaugcuagaugagggcgucgaaccagacgaugucgacugcuggugcaacaccaccuccaccugggucguguacgguaccugccaccacaagaaaggcgaagcccgacgaucacgacgcgcagucacacucccaagccacagcaccaggaaacuccaaacacgcagccagacauggcucgaaagccgcgaauauacaaaacaccuaauaagaguagaaaacuggaucuuccgaaacccaggcuucgcccucgcagccgccgcgaucgcauggcuacucgggagcucaaccucccaaaaagucaucuaccuaguuaugauacuacuaauagcacccgcuuacuccauccgaugcauaggcgucucaaaccgcgacuucgucgaaggaaugagcggaggcaccuggguagacguaguccucgagcacggagguuguguaaccgucauggcucaagacaaaccaacggucgacauagagcuaguaacaacaaccgucucaaacauggcagaaguccggagcuacugcuacgaagccagcaucuccgacauggccucugauucccgcugcccaacacaaggcgaggcuuaccuagacaaacagucagacacccaguauguuugcaaacggacacucgucgaccgaggguggggcaacggaugcggccucuucggcaaaggcucccucguaacaugcgcaaaauucgcuuguucaaagaaaaugacaggcaaaucaauccaaccggagaaccucgaauaccgcaucaugcucagcguccacgggagccaacacuccggaaugauagucaacgacaccggacacgaaaccgacgaaaaccgagcaaaaguggaaaucacgccuaacagcccccgggccgaagcaacccuaggaggcuucgggucccuggggcuugacugcgaaccucguaccggccuagacuucagcgaccucuacuaccuaaccaugaacaacaaacauuggcuaguacacaaagagugguuccacgacauccccuuacccuggcacgccggagcagacaccggcacaccccacuggaacaacaaagaagcccucguugaguucaaagacgcacacgcaaaacgccaaaccguagugguucuaggaucccaagaaggagccguccacaccgcccucgccggagcacucgaagccgaaauggacggcgcaaaaggcaggcucagcagcggacaccucaaaugccgacuaaaaauggacaaacuccgacucaaaggcguguccuacucccugugcacagccgccuucaccuucaccaaaauccccgccgaaacacuccacggcacgguaacaguagaacuacaauacgccgggacagauggaccaugcaaaguccccgcacaaauggcaguagauaugcaaacacuaacccccguaggccgccuuaucaccgcaaaccccgucaucaccgaauccacagaaaacuccaaaaugaugcuugaacucgacccaccauucggcgauucauacaucgucauaggcgucggagaaaagaaaaucacgcaccacuggcacaggagcggcuccaccauaggcaaagcguuugaagccaccgugcgcggcgccaaacgaauggcaguccucggagacacagccugggacuucggcuccguuggcggggcacuaaacucacucggcaaaggcauccaccaaaucuuuggagccgcguucaaaucacucuucgguggcaugucuugguucucucagauccuaaucggcacucuucucauguggcuaggacucaauaccaaaaacggcucgaucagccucaugugccucgcacucggcggcguacucauuuuccucagcacagccgucucagccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9560 - RNA, 2290 nt, Artificial Sequence
  KY014317.1 prME-short mRNA Design 3 opt
gggagaaagcuuaccaugacauccguaggaaucgucggacuccugcucacaaccgccauggccgccgaagucacaagacgaggcuccgcauacuacauguaccucgaccgcaacgacgccggcgaggcaaucagcuucccaaccacccucggcaugaacaaaugcuacauacaaauaauggaucuaggacacaugugcgacgccacgaugagcuacgaaugccccaugcuggacgaaggaguggagccagacgacgucgacugcuggugcaacaccacaagcacauggguuguauacggaaccugccaccacaagaaaggcgaggcccgccgcagcagacgagcaguaacucuaccaucccacuccacacgcaaacuccaaacucgaucccagaccuggcucgaaagccgagaauacacaaaacaucucauacgcgucgaaaacuggauauucagaaacccaggguucgcacucgccgccgccgccaucgccuggcuccuaggcagcagcacaucccaaaaagucaucuaccuaguaaugaucuuauuaauagcccccgcguacuccauacggugcaucggaguaucaaaccgagacuucguagaaggaaugagcgggggcacgugggucgacguuguccucgaacacggcggcugcguaaccguaauggcccaagacaaaccaacaguagacauagaacucgucaccacaaccgucagcaacauggccgaagugcgcucauacugcuacgaagccuccauuuccgacauggccucugacaguaggugcccaacgcagggagaagcauaccuagacaaacaaagcgacacccaauacgucugcaagcgcacucuagucgaccgaggauggggaaacgggugcggucuauucggaaaaggcagucuuguaaccugcgcaaaauucgcuugcuccaagaaaaugacaggcaaaagcauacaacccgaaaaccucgaauaccgcaucaugcucuccguccacggcucacaacacucagggaugaucgucaaugacacaggccaugaaaccgacgaaaaccgggccaaagucgaaaucacccccaacagccccagagccgaagcaacccuaggaggcuucggcagccuaggccucgacugcgaaccucgcaccggucuggacuucuccgaucucuacuaccucaccaugaacaacaaacauuggcucguccacaaagaaugguuccacgacaucccccucccauggcacgccggagccgacacaggaacaccacauuggaacaacaaagaagcacuggucgaguucaaagaugcccaugccaagagacagaccgucgugguccucggcucacaagaaggcgccguacacaccgcacucgccggagcgcucgaagccgaaauggacggagccaaagguaggcuaagcuccggacaccugaaaugcagacuuaaaauggacaaguuacgccucaaaggcgucucauacucccuuugcacagccgcauucacuuucacaaaaauccccgccgaaaccuuacacgggacaguaacuguggaagugcaauacgccggcaccgacggaccgugcaagguccccgcgcaaauggcagucgacaugcaaacacuaacacccguaggccgccugaucacagcaaacccuguuaucacagaaucaauagaaaacuccaaaaugaugcuugaacucgacccaccguucggagacagcuacaucguaauaggcgucggcgaaaagaaaauuacccaccacuggcaccgcucaggcagcacaaucggaaaagccuucgaagccacaguccggggcgccaaacgaauggccguccucggcgacaccgcaugggacuucggaucaguaggaggcgcacucaacagucuugggaaaggaauccaccaaauauucggagccgccuucaagagccucuucggaggcauguccugguuuagccaaauacuaauaggcacacuccuaauguggcuaggccucaacaccaagaacggcagcaucagccucaugugccucgcccucggaggaguacuaauauuccuauccaccgccgucagcgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9561 - RNA, 2290 nt, Artificial Sequence
  KU758876.1 prME-short mRNA Design 3 opt
gggagaaagcuuaccaugacaaguguaggaaucgugggucuccuccugacaaccgcaauggccgcagaaguaacacggcggggguccgcauacuacauguaccucgaccggaacgacgcaggcgaggccaucucuuuccccaccacccuaggcaugaacaaaugcuacauccaaauaauggaccuaggacacaugugcgacgcaaccauguccuacgaaugccccaugcuagaugaaggagucgaaccagacgacguggacugcuggugcaacaccaccaguaccugggucgucuacggaacaugccaccacaagaaaggggaggcucgcagaagccgccgagcugucacacucccaagccacagcaccagaaaacuccaaacacgaucccaaacauggcuagaaucgcgcgaguacaccaaacaccucauccgcguggaaaacuggaucuuccgaaacccaggcuucgcccucgcagcggcagcaauagcauggcuguuaggauccuccacaagccaaaaaguaauauaccugguaaugauccuacucaucgcacccgcauacuccauccgaugcauaggaguauccaaccgggacuucgucgaaggaaugagcggaggaaccugggucgacgugguccuagaacacggcggaugcgucaccgucauggcacaagacaaacccacaguggacaucgagcuaguaaccaccaccgugucaaacauggcugaaguuagauccuacugcuacgaagcaagcaucagcgacauggcgagugacagcagaugccccacacaaggcgaagcauaccucgacaaacaauccgauacccaauacguaugcaaacgcacacucguagaccgcgguuggggcaacggcugcggauuauucgggaaagggagccucguuaccugcgcaaaauucgccugcagcaaaaagaugacaggcaaaagcauccaacccgagaaucuagaauacagaauaaugcucuccguacacggaucccaacacucagggaugauaguuaaugacacaggccacgaaacagacgaaaaccgagccaaaguugaaauaaccccgaacucaccaagagccgaagccacccuaggaggcuucggaucucucggacucgacugcgaaccccgcacaggacuagacuucuccgaccuauacuaucucacuaugaacaacaagcacuggcucguacauaaagaaugguuccacgacaucccacuacccuggcacgcgggcgcagacacagggacgccccacuggaacaauaaagaagcgcucguagaguucaaggaugcucacgccaagcgccaaacagucguaguacuaggcucccaagaaggcgccguccacacagcccuagcaggagcccuggaagccgaaauggacggaguaaagggcagacucucuagcgggcaccuuaaaugccgacugaaaauggacaaacucagguuaaagggcguauccuauucacugugcaccgcggcauucacauucaccaaaaucccggccgaaacacuccacggcacaguaacggucgaaguccaauacgccggcacggacggacccugcaaaguacccgcccaaauggcagucgacaugcaaacccucacacccgucggaaggcuaauaacagccaaccccgucaucaccgaaagcaccgaaaacagcaaaaugaugcucgaacuagacccacccuucggcgacucauacauagugaucggcgucggcgaaaagaaaaucacgcaccacuggcacagaucaggaucgacaauaggaaaagccuucgaagcgacaguccgcggagcaaaacgaauggccguauuaggggacacagcaugggacuucggcuccgucggcggcgcacucaacucccucgguaaaggaauacaccaaauauucggugcagcuuucaaaucacuauucggcggcauguccugguucagccaaauucucaucggaacacuccucauguggcucggccuuaacacuaaaaauggcucaaucucguucaugugccucgcccuaggcggaguccugaucuuccucuccaccgcgguauccgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9562 - RNA, 2290 nt, Artificial Sequence
  KU758874.1 prME-short mRNA Design 3 opt
gggagaaagcuuaccaugacaagcguaggaauagucggacuacuacucacaacggcaauggcagccgaagucacccgaagagggagcgccuauuacauguaccuagacagaaacgacgcaggagaagcaaucucauuccccacgacacucgggaugaacaaaugcuacauacaaauaauggaccuaggacauaugugcgacgcgacaaugucauacgaaugcccaaugcucgacgaaggaguggaacccgacgacguagacugcuggugcaacaccacauccaccugggugguauauggcacaugccaccacaagaaaggcgaagcacgccgaagccgccgagcagucacacucccaagccacagcacccgcaaacuccagacaagaagccaaacauggcuagaaucccgagaauacacuaaacaccuaauacggguagaaaacuggauauucagaaacccaggauucgcacuugcagccgcagccaucgcuuggcuccuaggaagcuccacgucccaaaaagugaucuaucucgucaugauacuacugaucgcccccgccuacagcauacgcugcauaggcguaagcaaccgagauuucguggaaggaaugagcggcggcaccuggguagacgucguucuagaacacggaggcugcguaaccguaauggcccaagacaaacccaccguggacaucgaacugguuacaaccaccguauccaacauggccgagguuagaagcuacugcuacgaagcguccaucucagacauggccucagacucacgcugccccacacaaggagaagcauaccucgacaaacaaucagauacgcaguacgucugcaaaagaacacugguggaccgcggcuggggaaacggaugcggccuguucgguaaaggcagccucgucacaugcgcaaaauucgcgugcucgaaaaagaugacaggcaaaagcauacaacccgaaaaccuagaauaccgaaucaugcuauccguccacggcucacaacacucuggaaugaucgucaacgacacgggccaugaaacggacgaaaacagagccaaagucgagauaacacccaacagccccagggccgaagcgacacucggaggcuucgguagccugggacuagacugcgaaccgcgcacaggccuggacuucagcgaccuuuacuaccugaccaugaauaacaaacacuggcucguccacaaggaaugguuccacgacaucccccugccauggcaugccggcgcagacaccggcaccccacacuggaacaacaaagaagcccuaguagaguucaaagacgcacacgcaaaacgccagacaguaguaguccugggcucacaggaaggcgcagugcacaccgcacuggcaggcgcgcuggaagccgagauggacggcgccaaagguaaacuaucuucgggccaccucaaaugccgucuaaaaauggacaaacuaagacuaaaaggggucuccuacagccucugcaccgcagccuucaccuuuacaaaaauaccagcagaaacacuccacgggacaguaaccgucgaagugcaguacgccggcacagacggccccugcaagguccccgcacagauggcagucgacaugcagacacucaccccaguaggacgccucauaaccgcaaaccccgucaucaccgaaagcaccgagaacaguaaaaugaugcucgaauuggacccaccauucggagacagcuacaucguaauaggaguuggcgaaaagaaaaucacacaccauuggcacagaagcgggagcaccauaggcaaagcauucgaagccacgguccgaggcgcaaaacggauggcagugcuaggcgacaccgcaugggacuuuggaagcgugggcggagcacugaacagucuaggaaaaggcauacaccagauauucggagcagcguucaaaagccuguuuggcggaaugucaugguucucgcaaauccucauaggcacccuacuuauguggcuagggcucaacaccaaaaauggaagcaucagccuaaugugccuagcacuagggggcguccuaauauuccucagcaccgccguaagcgcaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9563 - RNA, 2290 nt, Artificial Sequence
  KY317939.1 prME-short mRNA Design 3 opt
gggagaaagcuuaccaugacgagcgucggaaucgucggacuccuccuaaccaccgcaauggcggccgaagucacccgccgaggcagcgcauacuacauguaccuagaccgaaaagacgccggagaagcgaucagcuuccccaccacacuaggaaugaacaaauguuacauacaaaucauggaucugggacacaugugcgacgccaccaugagcuacgaaugccccaugcucgacgaaggcguagaaccggacgacguagacugcuggugcaacaccaccagcaccugggucguauacggaaccugccaccacaagaaaggagaagcacggcgaagccgacgcgccgucacacuccccucacacagcacccgcaaacuccaaacccgaucccaaaccuggcucgagagcagagaauacacgaaacacuuaauacgaguagagaacuggauauuccgcaaccccggauucgcacuagcagcagccgccaucgccuggcuacucggcucauccacaucacaaaaagucaucuaccuggucaugauacuacuaauagcacccgccuacagcauacgcugcauaggaguaagcaaccgcgacuucgucgaaggaauguccggcggcaccuggguagacguaguccuggagcacggcggcugugucaccguaauggcacaagacaaacccaccguagacaucgagcuaguaacaaccaccgucaguaacauggcagaaguacgauccuacugcuacgaagcaagcaucuccgacauggcgucagacucccggugucccacgcaaggagaagcauaccucgacaagcaaagcgacacacaauacgucugcaaacgaacccucgucgaccgaggauggggcaacgguugcggccuguucggaaaaggaucccucgugaccugcgcaaaauucgcaugcagcaagaaaaugaccggcaagagcauccaacccgaaaaccuagaauaccgcaucaugcugucaguccacggcagccaacacagcgggaugauagucaacgacacuggccacgaaaccgacgaaaacagagcaaaaguggagauaaccccaaacagcccccgagccgaggcaacacucggaggauucgggagccucggccucgacugcgaacccaggaccggacucgacuucagcgaccucuacuaccugaccaugaacaacaaacacuggcucguccacaaagaaugguuccacgacauaccucugccuuggcacgcaggcgccgacacgggaacuccacacuggaacaacaaagaagcccucguagaguucaaggacgcccacgcgaaaaggcaaacgguaguuguacuaggcagucaagaaggcgcaguacacaccgcccuagccggcgcccuagaagccgaaauggacggcgccaaaggccgucuauccagcggacacuuaaagugccgacuaaaaauggacaaacuucgccucaaaggggucucauacagucucugcaccgcugcguuuaccuucaccaaaauccccgcagaaacacuccacggaacugucacagucgaagugcaauacgccgggacagacggccccugcaaaguaccagcacagauggccgucgacaugcagaccuuaacaccugucggaagacucaucacagccaaccccgucauaaccgaauccacagaaaacagcaaaaugauguuagaacucgacccucccuucggagacucauacauaguaaucggcgugggcgaaaagaaaaucacccaccacuggcacagauccggauccaccaucggaaaagccuucgaagccaccguccgaggcgccaaacgcauggccguauugggagacacagcaugggacuucggguccguaggaggcgccuuaaacucgcuagggaaaggcauccaccaaaucuucggagccgccuucaaaagccucuucgguggcaugagcugguucucccaaauccucaucggcacgcuccuaauguggcuaggucugaacaccaagaacggcucaauaucccuaaugugccucgcacuaggcggaguccuaauauuccuaucaaccgccgucucagcaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9564 - RNA, 2290 nt, Artificial Sequence
  KY014314.1 prME-short mRNA Design 3 opt
gggagaaagcuuaccaugaccuccgugggaaucguaggacugcuacucacaacagccauggcagcagaagucacccgaagaggcucugcguacuacauguaccuagaccgcaacgacgccggggaagcgauaucauucccaacaacacucggcaugaacaaaugcuacauccaaauaauggaccuaggccacaugugcgacgccacaaugagcuacgaaugcccaaugcucgacgaaggaguggagccagaugauguggacugcuggugcaacacgaccucaaccuggguaguauacggcacaugccaccacaaaaagggcgaggcccgcagaagccgcagagcagucacccuacccucacacucuacaagaaaacuacaaacacgcucccaaacauggcuagaaagcagagaauacacaaaacaccuaauacgaguagagaacuggaucuuccgaaacccaggcuucgcauuggcagccgccgcaaucgcuuggcuacuaggguccagcaccagccaaaaagucaucuaccuaguuaugauacuccucaucgccccagccuacagcauccgaugcauugguguaucaaacagggacuucguagaaggaaugagcggcggaacauggguagacgugguccucgaacacggcggcugcguaacgguaauggcccaagacaaacccacaguagauauagagcuagucacaacgacaguaagcaacauggccgaaguaagaagcuacugcuacgaagcaagcauaagcgacauggccucggacuccaggugccccacgcagggcgaagcauaccuagacaagcagagugacacccaauacgucugcaagcgcacgcuaguagacagaggauggggaaacgguugcggccuauucggaaaagggucacucgugaccugcgcaaaguucgccugcaguaaaaagaugacaggcaaaagcauacaacccgagaaccuggaauaccguaucaugcucagcguacacggcucacaacauagcgggaugauagucaacgacacaggccacgaaacggacgagaacagagcaaaagucgaaauaaccccaaacucaccccgagcagaagcaacccuaggcggcuucggaucccugggacuagacugcgaacccagaacaggccuugacuuuuccgaucuguauuaccugacaaugaacaacaagcacuggcuaguacacaaagaaugguuccacgacauaccccuacccuggcacgcaggcgccgacaccggcacaccccacuggaacaacaaagaagcccucguagaguucaaagaagcccacgcaaagcgccaaacgguagucguacuggggagccaagagggagccguacacacagcgcuagcgggagcacucgaagcagaaauggacggggccaaagggagacuuagcagcggccaccuaaaaugccgacuaaaaauggacaaacuccgccuaaagggaguaucauacucccugugcacagcagcauucaccuucaccaagauccccgcagaaacacuccauggcacagucacaguagaaguacaguacgccggcaccgacggacccugcaaaguaccagcacaaauggccguagacaugcaaacacuaaccccaguaggcagacucaucacagcuaauccaguaauaacagaaagcaccgagaacaguaaaaugaugcuggagcucgacccgcccuucggcgacuccuacaucguaauaggagugggcgagaaaaagauaacacaccauuggcacagaagcggcagcaccauaggcaaagcauucgaagcgacggugcgcggggcuaaacgcauggcagugcuaggcgacaccgcgugggacuucggcucaguaggaggggcacuaaacucacucggaaaaggcauacaccagaucuucggagcagccuuuaagagccucuucggaggcaugagcugguucucgcaaauacucaucggcacacuucucauguggcucgggcuaaacaccaaaaacggaucaaucagccucaugugccuagcacuaggagggguccucaucuuccuaagcacggcggucagugccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9565 - RNA, 2290 nt, Artificial Sequence
  KX447517.1 prME-short mRNA Design 3 opt
gggagaaagcuuaccaugaccagcguuggaauagucggccuacuacuaaccacagcaauggccgccgaagucacacgcagaggguccgcuuacuacauguaccuagaccgaaacgacgcgggcgaagcaaucagcuuccccaccacccucggaaugaacaaaugcuacauccaaaucauggaccuaggacacaugugcgacgcgacuaugaguuacgaaugccccaugcucgacgaaggagucgaaccggacgacguagacugcuggugcaacaccacguccaccuggguaguauacggaaccugccaccacaagaaaggcgaagcacgccgaagccgccgcgccgucacgcugccaucucacucaacacgaaaacuacaaacacgaagucagacauggcuagagagccgcgaguacaccaaacaccugauaagaguugaaaauuggauauucagaaacccaggcuucgcgcuggcggcagcagccaucgccuggcuccucggaucauccaccagccagaaagucauauaccuaguaaugauccuccucaucgcaccagcguacagcauccgcugcaucggcguaagcaaccgcgauuucguagaaggcaugagcggaggcaccuggguagacguaguacucgaacacggaggaugcguaaccgucauggcccaagacaaacccacagucgacaucgaacucgucaccaccacaguaagcaacauggccgagguccgcagcuacugcuacgaggcaagcaucagcgacauggcaucggacucccgaugcccaacccaaggggaagcguaccuagauaaacaaagcgacacacaauacgucugcaaacgcacacuuguagaccgaggaugggguaacggaugcggacucuuuggcaaaggcagccucgucacaugcgccaaauucgcaugcucaaagaaaaugacaggaaaauccauccagcccgagaaccuggaguaccgcaucaugcucaguguccacgggagccaacacucaggcaugaucgucaacgacacgggccacgaaaccgacgaaaaccgagccaaagucgaaaucacccccaacucgccaagagcagaagccgcccucggcggcuucggaucacucggacuggacugcgaacccagaacuggacucgacuucucagaccucuacuaccucaccaugaacaacaaacacuggcucguccacaaagaaugguuccacgacauaccccuacccuggcacgccggugcugacacaggcacuccacacuggaacaacaaagaagcccuaguagaguucaaagacgcacacgcaaaacgccaaaccguagucguacuagggagccaagaaggcgccguacacaccgcacuagcaggcgcacuagaagcagaaauggacggcgcaaaaggcagacugucuagcggccacuuaaaaugccgucucaaaauggacaaacugagacucaaaggaguaagcuacucccuaugcacagcagcauucacauucacaaaaauacccgcagaaacacuacacggcacaguaaccgucgagguacaauacgcagggacagacgggcccugcaaagucccagcacaaauggccguggauaugcaaacccucacacccguaggacgacuaauaaccgcaaacccagucauuacagaauccaccgaaaacagcaaaaugaugcucgaacuagacccaccauucggcgacucauacaucgucauaggagucggggaaaagaaaaucacacaccacuggcaccgcagcgggucgaccaucggcaaagccuucgaagcgacaguuagaggggcaaaaaggauggccguccuaggcgacaccgcgugggacuucggcuccguaggcggagcccuaaacagucucggcaaaggaauacaccaaaucuucggagcagcguucaaaucacuauuuggcggcaugucuugguucucacaaacccuaaucgggacccuccucauguggcucggccuaaacaccaaaaacggcuccaucagccucaugugcuuagcccucggcgggguccuaauauuccuuuccacagcagucagcgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9566 - RNA, 2290 nt, Artificial Sequence
  KU926310.1 prME-short mRNA Design 3 opt
gggagaaagcuuaccaugaccagcguaggaaucgucggccuccuacuuaccaccgcaauggccgcagaagucacccgucgaggcucagccuacuacauguaccucgacagaaacgacgccggcgaagccaucagcuuuccgacaacgcuuggcaugaacaaaugcuacauacaaauaauggaccucggccacaugugcgacgcaacgaugucauaugaaugcccaaugcuagacgaaggcguagaaccagacgacgucgacugcugguguaacacaacauccaccuggguggucuacggaaccugccaccacaagaaaggagaagcucgacgaagccgacgcgccguaacacugcccagccauuccacgcgcaaacuccaaacacgcucccaaaccuggcuugagagccgagaguacacaaaacaccuaauacgcguggaaaacuggauauuccgaaaccccggcuucgcacucgccgcagccgcaauagcguggcuucuaggaagcuccaccucacagaaagugauauaucugguaaugauacugcucauagcacccgccuacagcauaagaugcaucggcgucucaaacagggacuucgucgaaggaaugagcggagggacgugggucgacgucguccuagaacacgggggcugcguaacagucauggcgcaagacaagcccacgguagacaucgaacuggucaccaccacagucucaaacauggccgaaguacgcuccuauugcuaugaagccucaaucucagacauggcguccgacagccgcugccccacccaaggcgaagccuaccucgacaaacaaucggacacccaauacgucugcaaaagaacacuuguagacaggggauggggcaacggaugcggacucuucggcaagggcagccuaguaacaugcgccaaauucgccugcucaaagaaaaugaccggaaaguccauccaacccgaaaaccuagaauacagaaucaugcuauccguacacggcagccaacacuccggcaugaucgucaacgacaccggccacgaaacagacgaaaaccgagccaaggucgaaauaacccccaacucacccagggcggaagcaacacuuggcggauucggcagccucggccuagacugcgaaccacgcaccggccuagacuucagcgaccucuacuaccuaacaaugaacaacaaacacuggcucguacauaaggagugguuccaugacauaccgcuacccuggcacgcaggcgccgacaccggaaccccacacuggaacaacaaagaagcgcucgucgaguucaaagacgcccacgccaaacgccagaccguagucguccuaggaucacaagaaggcgcuguacacacagcccucgccggagcccucgaagccgaaauggacggagcaaaaggccgccucagcagcgggcaccuaaaaugccgacuaaaaauggacaaacuccgucucaaaggaguaagcuacucccucugcacagccgcuuucaccuucacaaaaauaccagccgaaacccuccacggcaccgucacaguagaaguccaauacgcaggggcugacggacccugcaaaguccccgcccaaauggccguagacaugcaaacgcucaccccagucggcagacuuauaaccgcgaaccccguaaucaccgaaagcaccgaaaacucaaaaaugaugcucgagcuagacccacccuucggcgacagcuacaucgucaucggcgugggagaaaagaagaucacacaccacuggcacagaagcggcucgacaauaggcaaagcauucgaagccaccguacguggcgcgaaacgcauggccgugcucggagacaccgcuugggacuucgggagcguagggggagcccucaacucccucggcaagggaauacaccaaauauucggcgcugccuucaagagccucuucggcggaaugaguugguucucccaaauacucaucggaacucuccuaauguggcucggacucaacaccaaaaacggcucgauuucccucaugugccuugcacuuggcgguguccuuauauuucucuccaccgccguaucagcaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9567 - RNA, 2290 nt, Artificial Sequence
  KU922923.1 prME-short mRNA Design 3 opt
gggagaaagcuuaccaugaccagcgucggcauuguaggccuauuacuuacaacagcuauggccgccgaagucacaagacggggauccgccuacuacauguaccuagaccgcaacgacgccggagaagccauaucauuccccacaacccuaggcaugaacaagugcuacauacaaauaauggaccuuggucacaugugcgacgccacaaugagcuacgaaugucccaugcucgacgaaggcguagagcccgacgacgucgacugcuggugcaacacaacauccacguggguaguauacgggaccugccaccacaagaaaggcgaggccagacggucacgacgagccguaacccuacccucccacuccacccgaaaacuccaaacacgcagccaaacuuggcuagaaucacgagaauacaccaaacaccuaauccgcguagagaacuggauauucagaaacccaggauucgcacuagccgccgccgcaauagccuggcuccuaggcucaucgaccucacagaaaguaaucuaccucguaaugauacuucucaucgcacucgccuacagcauccgcugcaucggcguaagcaaucgcgacuucgucgagggaaugucaggaggaacaugggucgacgucgugcuagagcacggcgggugcguaacggucauggcacaagacaaacccaccgucgacaucgaacucguaacgaccacagucucuaacauggccgaaguacgaaguuacugcuacgaagccuccauaucggacauggcaagcgacucccgcugcccgacccaaggagaagccuaccuggacaaacagagcgacacacaauacgugugcaaacgaacucuagucgaccgcggauggggcaacggaugcggccucuucggaaaaggaagccuaguaacaugcgcgaaauucgcuugcuccaagaaaaugaccgggaaauccauccaaccugagaaccuggaauaucgaauaaugcuauccguacacggcucccaacacuccggcaugaucgucaacgacacuggacaugaaacagacgaaaaccgcgccaaaguggaaaucacacccaacuccccacgcgcggaagcaacgcucggaggauucggcucacuaggccuagacugcgaacccagaaccggacuagacuucagcgaccucuacuaccucacaaugaacaacaaacacuggcuaguccacaaagaaugguuccacgacaucccccuaccauggcacgcaggggcggacacgggaacaccccacuggaacaacaaagaagcucucguagaguucaaagacgcgcaugcgaaacgacaaaccguaguaguccucggaucgcaagaaggagcaguacacaccgcccuggccggcgcccuagaagccgaaauggacggagcaaaaggccgacucagcagcgggcaccucaaaugcagacuaaaaauggacaaacuaagacucaaaggcguaagcuacagccuuugcacagcagccuuuacauucacaaaaauucccgcugaaacacuccacggcaccguaaccguagaaguccaauacgcaggcaccgacggaccaugcaaagucccagcacagauggcugucgacaugcaaacacucacacccguaggacgacuaauaacugccaaccccgugaucaccgaaagcacagaaaacagcaagaugaugcucgaacuggacccacccuucggcgacuccuauaucgucauuggagucggagaaaagaaaaucacccaccacuggcaccgcagcggcuccacaaucggcaaggccuucgaagcaaccguaagaggcgccaaaagaauggccguacuaggagacacggcaugggacuucggcagcguaggcggggcacucaacagucuaggaaagggcauccaccaaauauucggcgcagccuucaaaucacuauucggcggcaugagcugguucagucaaauacucauaggcacgcugcuaauguggcucggccucaauaccaaaaacggaucgaucucccucaugugccucgcccuuggaggcgugcuaaucuuccuauccaccgcagucagcgcaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9568 - RNA, 2290 nt, Artificial Sequence
  KY075937.1 prME-short mRNA Design 3 opt
gggagaaagcuuaccaugaccuccguaggaauagucggccuccuccugaccacagccauggccgccgaagugaccagacgcggcucagcauacuacauguaccucgacaggaacgacgccggcgaagccaucucauucccgaccacauuaggcaugaacaaaugcuacauccaaaucauggaucuaggccacaugugcgaugccaccaugucauacgaaugccccaugcucgaugaaggcgucgaaccggacgacguagacugcuggugcaacaccaccuccaccugggucguauacggaaccugccaccacaagaaaggugaagcacgcagaagccgacgcgccgugacacuucccucacacuccacccgaaaacuacaaacacgcucacaaaccuggcuagaaucccgcgaauacaccaaacaccucauacgcgucgaaaacuggaucuuucgaaacccaggauucgcucucgccgcagccgcaaucgcauggcuucucggaucuuccacaucccaaaaagucaucuacuuaguuaugauccuccucaucgccccagccuacuccauacgaugcaucggcguaagcaaccgcgacuucgucgaaggcaugucgggaggcacguggguagacgucguucuagaacacgguggcugcguaacaguaauggcccaagacaagcccaccgucgacauugaacucgucaccaccacuguaucaaacauggcugaaguccgcagcuacugcuacgaagcaagcaucuccgacauggucuccgacagccgcugcccaacccaaggcgaagcguaccuagacaaacagucggacacccaauacgucugcaaacgcacccuagucgacagagguuggggcaacggaugcggacucuucggcaagggaucccuaguaacaugugccaaauucgcgugcucgaagaaaaugaccggaaaaagcauccagcccgaaaaccucgaauaccgcauaaugcucuccguccacggaagccaacacuccggcaugaucgugaacgacaccggacacgaaaccgacgaaaaccgcgcuaaaguagaaaucacaccaaacucaccccgcgcagaagcaacccuaggaggcuucggaucccucggccuagacugugaaccccggaccggccuagauuucuccgaccucuacuaccuaaccaugaacaacaaacacuggcucguacauaaagagugguuucacgacaucccccuccccuggcacgcgggcgcagacacagguacaccccauuggaacaacaaagaagcccuugucgaguucaaagacgcacacgccaaaagacaaaccgucgucgugcuuggcucccaggaaggagccgugcacacagcccuggccggagcgcuagaagcagaaauggacggcgccaaaggaagacuaagcuccggacaccuaaaaugccgacuaaaaauggacaaacuucgacuuaaaggagugucauacucacucugcacggccgcauuuaccuucaccaaaauccccgcagaaacacuacacggcaccgucaccgucgaaguacaauacgccggaaccgacggcccaugcaagguaccagcacaaauggccgucgacaugcagacacuuaccccgguaggccgacugauaaccgcuaacccagucaucaccgaaucaaccgaaaauucgaaaaugaugcuggaacucgacccacccuucggagacucauauaucgucauaggcguaggagaaaagaaaaucacccaccacuggcaccgcucuggcagcacaauaggaaaagccuucgaagccacagucagaggcgccaaacgcauggccgugcucggcgacaccgccugggacuucggaagcgucggaggcgcccucaacagccugggcaaaggaauccaccaaauauucggagcagccuuuaaaucccuuuucggaggaaugucaugguucucccaaauucuaauuggcacacuccuaauguggcucggacuaaacaccaaaaauggcucaauaagccugaugugucuagcacuaggaggcguacucaucuuccuuagcaccgccgucagcgcaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9569 - RNA, 2290 nt, Artificial Sequence
  KY003156.1 prME-short mRNA Design 3 opt
gggagaaagcuuaccaugaccuccguaggcauagucggccuacuccugacaaccgcaauggcagccgaagucacacgccgcggaagcgccuacuacauguaccucgaccgaaaugacgccggcgaagccaucagcuuccccaccacgcucggcaugaacaaaugcuacauacaaaucauggaccucggccacaugugcgacgccaccaugucguacgaaugccccaugcuagacgaaggcgucgaaccagacgacguagacugcuggugcaacaccacaucgacauggguaguguacggaacaugccaccauaagaaaggagaagcaagacgcagcaggcgagcggucacccuacccagccacuccacgagaaaacuccagacacgcucccaaacauggcucgaaagcagagaauacacuaaacaccucauccgaguagaaaauuggauauuuagaaacccaggcuucgcgcuagcggcagccgcaaucgccuggcuacucgguaguuccacaucacaaaaaguaaucuaccucguaaugauccuccuaauugcaccagcauacuccauaagaugcaucggcaucuccaacagagacuucguggaaggcaugucagggggaacauggguagacguuguacucgagcacggcggcugcguaaccguaauggcccaagacaaaccaacaguggacaucgaacucguuaccacaaccgucaguaacauggccgaaguccguuccuacugcuacgaggccaguauauccgacauggccagcgacagccgcugcccaacccaaggggaagccuaccucgacaaacaaucagacacccaauauguuugcaaaagaacccuagucgaccgaggcuggggaaacggaugcggacuuuucggcaaaggcucgcucgucacaugcgccaaauucgcaugcuccaagaaaaugaccggcaaaagcauacaaccagaaaaccucgaauaccgcaucaugcucuccguacacgguagccaacacagcgggaugaucgucaacgacacaggccacgaaaccgacgaaaaccgcgcgaaagucgaaauaaccccuaacucaccccgugccgaagcaacacuuggcggguucgguauccugggccucgacugcgaacccagaaccggccucgacuucuccgaccucuacuaccuuaccaugaauaacaaacacuggcuaguccacaaagaaugguuccacgacauaccgcuccccuggcacgccggagccgacacaggcacaccccacuggaacaacaaagaagcccugguagaguucaaggacgcgcacgcaaaacgacagaccguagucgugcucggcagucaagaaggugcugugcacacggcacucgccggugcacuggaagcagaaauggacggagcaaaaggccgccuauccagcggccaucucaaaugccgacucaaaauggacaaacuacgucuaaaaggagugucguacagccuaugcacagccgccuucacauucacgaaaaucccagccgaaacacuacacggaacgguaacaguagaaguacaauaugcaggcaccgacggaccaugcaaaguacccgcccaaauggccguugacaugcaaacucuaacuccaguaggacgccugauuaccgccaacccagucaucaccgaaagcaccgaaaacucuaaaaugaugcucgaacuggacccaccauucggugacagcuacaucgucauaggcguaggagaaaagaaaaucacccaccacuggcaccgcagcggcuccaccauaggcaaagcauucgaagcaaccguccggggagccaaacgcauggcaguccucggcgacaccgccugggauuucggguccgucggcggggcccucaauucccuggggaaaggaauacaccaaaucuucggggccgccuucaaaagccuuuucggcggaaugucaugguucucucaaauacucaucggaacccuacuaauguggcuuggccugaacaccaaaaacggaagcaucucacucaugugccucgcacuuggaggcgugcucaucuuccuauccaccgcagucagugccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9570 - RNA, 2290 nt, Artificial Sequence
  KU312313.1 prME-short mRNA Design 3 opt
gggagaaagcuuaccaugacaagcguaggcaucguaggacuccuccuaacaaccgccauggcagcagaaguuacacgccggggaucagcauacuacauguaccuagaccgcaacgacgccggugaagccaucucguuccccacaacacugggcaugaacaaaugcuacauccaaaucauggaccucggacauaccugcgacgcaacaaugucauaugaaugccccaugcuagacgaaggcgucgaacccgacgacguagacugcuggugcaacaccaccagcacguggguagucuauggcaccugucaccacaagaaaggcgaagcacgccguucucgcagagcagucacccuacccucacacagcauccgcaaacuucaaacccgcucccaaacauggcucgagucccgggaauauacgaaacaccucauacgaguagaaaacuggaucuuccgcaaccccggcuuugcccuagccgcagcagcaauagccuggcuauuaggcuccagcaccagccaaaaaguaaucuaccuggucaugauccuccucauugccccugcauacucaauacgcugcaucggagucucaaacagggauuucgucgagggaaugucgggcggaacgugggucgacgucguccucgaacacgguggcugcgugacagucauggcccaagacaaaccgacaguugacauagaacuugucaccacaacaguaucaaacauggcggaaguccgcagcuacugcuacgaagccucaauauccgacauggcaagcgacagccgaugcccaacccaaggcgaagcauaccucgacaaacaauccgacacgcaauauguaugcaaacgcacccuaguagaccggggcuggggaaacggcugcggacucuucggcaaaggcagccuagucacaugcgcuaaauucgccuguagcaagaaaaugacaggcaaaagcauccaacccgaaaaucucgaguaccgaaucaugcuaagcguacacggcucacaacacucaggaaugauagucaacgacacaggacacgagacagacgaaaaccgcgcaaaagucgagauaacgcccaacuccccacgcgcagaagcaacacucggcggcuucggaagucucggucuagacugcgaaccccgaacaggacuagacuucucagaccuauacuaccugacuaugaacaacaagcacuggcucguccacaaagaaugguuucacgacauccccuuaccauggcacgcaggcgcugacaccggcacaccacacuggaacaacaaagaagcacucgucgaguucaaagacgcucacgccaaacggcaaaccgucguuguccugggcucccaagaaggcgcgguacacaccgcccucgccggcgcucucgaggcagaaauggacggagcaaaaggacgccucuccaguggacaccucaaaugcagacuaaaaauggacaaacuacgccucaaaggugucucauacagccucuguacagcagcauucaccuucaccaaaaucccggccgagacacuccacggaaccguaaccguagaaguccaauacgcagggacagacggacccugcaaagucccagcacaaauggcaguagacaugcaaacacuaacacccgugggaagacucaucaccgcaaaccccgucaucaccgaaagcaccgaaaacagcaaaaugaugcuagaacuagacccacccuucggcgacucauacauaguaauaggcgugggagaaaagaaaaucacccaccacuggcaccgcagcggaucaaccauaggcaaagcauucgaagccacaguccgcggugcaaaacgcauggccguccucggcgacacagccugggacuucggcagcguaggcggcgcccuaaacucgcuaggaaaaggcauacaccagaucuucggggcagccuucaagagucucuucggcgguauguccugguucagccaaauccucaucgggacccuacucauguggcucggccucaacgccaaaaacggcucgaucucacucaugugccuagcacucggcggcguccucauauuccugucaacagccguaagcgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9571 - RNA, 2290 nt, Artificial Sequence
  KY075935.1 prME-short mRNA Design 3 opt
gggagaaagcuuaccaugacaucagucgggauagucggccuacuacuaaccacggccauggcagccgaaguaacccgacgcggaucggcauacuacauguaccuagacagaaacgacgcaggagaagccauaucuuuccccaccacauuaggcaugaacaaaugcuacauccaaaucauggaccuaggacacaugugcgacgcaacgaugucguaugagugccccaugcucgacgaagggguggaacccgacgacguagacugcuggugcaacacaaccucaaccugggucguauacggaaccugccaucauaagaaaggggaagcccaacgcucccgcagagccguaacacuacccagccacagcaccagaaaacuacaaacccgcucacaaaccuggcuggaaucacgcgaguacaccaaacaccuaauaaggguagaaaacuggauauuccggaacccaggcuucgcccucgccgcagcagcaauagcauggcuacucggauccucaacaucccagaaagugaucuaccucguuaugauacuccuuaucgcccccgccuacagcauccgaugcauaggcgucagcaaccgagacuucguagaaggaaugagcggcggcaccuggguagacgucguacucgagcacggcgguugugucaccgucauggcccaggacaaaccaacaguagacauugaacucgugacaacaacggucuccaacauggcagaaguacgcagcuacugcuacgaagccagcaucagcgacauggccuccgacagccgcugccccacacaaggagaagcguaccuggacaaacaaucagacacccaauacgucugcaaacgcacccuagucgaccgaggauggggcaacggaugcggccucuucggcaaaggaucgcucguaacaugcgccaaauucgccugcagcaagaaaaugaccggaaaaucaauccaacccgaaaacuuagaauaccgcauaaugcuaucaguccacggcucacaacacagcggcaugaucguaaacgacaccggccacgaaaccgaugagaaccgcgcaaaggucgaaauaacccccaacagcccccgcgccgaagcaacccuaggaggauuuggaagccucggccuagacugcgaaccacgcaccggccucgacuucuccgaccuauacuaccucaccaugaacaacaagcacuggcugguccacaaagaaugguuccacgacaucccccuccccuggcacgccggagccgacacgggaacaccccacuggaauaacaaagaggcccuaguagaguucaaagacgcacacgcgaaacggcaaacaguaguuguacucggaucacaagaaggggccguacacacagcccuagcaggagcacucgaagcggaaauggacggagccaaaggcagacucagcagcgggcaucuaaaaugccgacucaaaauggacaaacuccgauugaaaggcgucagcuacagccucuguaccgcagcauuuacauucaccaagauacccgccgaaacacuacacggaacaguaaccguagaaguccaauacgccgggacagacgggcccugcaagguacccgcacagauggcaguggacaugcaaaccuuaacaccgguaggacgacugaucacagcgaacccagucaucacggaaucaaccgaaaacuccaaaaugaugcuggaacuagacccgccuuucggcgauagcuacaucguaauuggagugggcgaaaagaaaaucacacaccacuggcaccgcuccggcucaacaaucggaaaagccuucgaagccaccguccgcggcgccaaaagaauggcaguccuaggagacacagcaugggacuucgguagcguaggcggagccuuaaacucacugggaaaaggcauccaccaaaucuucggagccgcauucaaaucacuauucggaggaauguccugguucagucaaauacucaucggcacgcuacucauguggcuaggacucaacaccaaaaacggaagcaucucgcugaugugccuagcccuaggaggcguacucauauuccuauccacagcggucucagcaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9572 - RNA, 2290 nt, Artificial Sequence
  KY014320.1 prME-short mRNA Design 3 opt
gggagaaagcuuaccaugacaagcgucggaauagugggacuccuacucacaacagcaauggcggccgaggucacacgacgaggaagcgccuacuacauguaccuagaccgcaacgacgcaggagaggccaucucguuccccacgacccuaggcaugaacaaaugcuacauccagaucauggaccucggucacaugugcgacgcaacaaugucguacgaaugccccaugcucgacgaaggggucgaaccagacgacguagacugcuggugcaacacaacaagcaccugggugguauacggcaccugucaccacaagaaaggagaagcccgaagaagccgcagagccguaacacucccaagccacuccacccggaagcuacaggcacgcagccaaaccuggcuagaaagcagagaauacaccaaacaccucauacgcgucgaaaacuggauauucagaaaccccggauucgcccuagccgccgccgccaucgcguggcuuuuagguuccuccacuagccaaaaaguaauauaccuaguaaugauacuccuaauagcgccagccuacagcaucagaugcauaggcguauccaacagagacuucgucgaaggcauguccggaggaacaugggucgaugucguacuagaacacggcggcugcguaaccgucauggcccaagacaaaccaacaguagauauagaacucgucacuaccacgguaagcaacauggccgaggugcgcucauacugcuacgaggccagcaucucagacauggcaucagacucacgcugcccaacacaaggagaagcauacuuagacaaacaaagcgacacacaauacguaugcaaacgcacccuaguagauagaggcuggggcaacgggugcggacucuucggcaaaggaucccuagucacaugcgcgaaauucgccugcucaaagaaaaugacaggaaaaucaauacaaccagaaaaccucgaauaccgcaucaugcuaagcgugcacggaucacaacacuccggcaugaucguaaacgacacaggccacgaaacagacgaaaaccgagcaaaaguggaaauaacaccuaacucaccacgcgccgaagccacccuagggggcuucggcucacucggccucgacugcgaacccaggacaggccuggacuuuucggaccuguacuaccuuacaaugaacaacaaacacuggcuaguacauaaagaaugguuccacgacauuccacuucccuggcacgcaggagccgacaccggcaccccacacuggaacaauaaggaagcacucguagaguucaaagacgcccacgccaagagacagacaguagucguacucggaucccaggagggcgcaguacacacggcccuagcgggcgcacuagaagccgagauggacggcgccaaaggccggcucagcagcggccaccucaaaugccggcuuaaaauggacaagcucagacugaaaggcguaucauacagccuaugcaccgccgccuucacguucacaaaaaucccagcggaaacacuacacggaaccgucacagucgaagugcaauacgcgggcacagacggccccugcaaagugcccgcccaaauggcggucgacaugcaaacacuaaccccaguaggaagacucaucaccgcaaacccggucauaacagaaagcacagaaaacagcaagaugaugcuagaacuagacccaccauucggcgacucauacauagucaucggcguaggagaaaagaaaaucacacaccacuggcaccgaagcggcucuacaaucggaaaagccuucgaagccaccguacgcggcgcgaaacgcauggccguccucggagacacagcaugggacuuuggcagcguaggaggcgcccucaacucccuaggcaaaggcauccaccaaauauucggggccgccuucaaaucccucuucggaggaaugucaugguucagccagaucuuaauaggaacccugcuaauguggcuaggccucaacacgaaaaacggguccauaucgcuaaugugccuagcacugggcggaguccucauauuccuaucaacagccguauccgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9573 - RNA, 2290 nt, Artificial Sequence
  KY328290.1 prME-short mRNA Design 3 opt
gggagaaagcuuaccaugacaagcgucggcaucguaggccuccuccugaccacagccauggcagccgaaguuacacgccgaggaucagcauacuacauguaccucgaccgcuccgacgcgggagaagccaucagcuucccuaccacccucggcaugaacaaaugcuacauacaaauaauggaccugggacacaugugcgacgcaacaaugucguacgaaugcccaaugcuagacgaaggcgucgaacccgaugacguagacugcuggugcaacaccacauccaccuggguggucuacggaaccugccaccacaaaaagggcgaggccagacggucgagacgcgcggucacccuuccuagccacagcaccagaaaacuacaaacacggucgcagacuuggcucgaaaguagagaguauaccaaacaccucauccgggucgaaaauuggaucuuccgcaaccccggauucgcgcucgccgccgccgcaauagcguggcuacucggcagcuccacaagccaaaaagucauauaccucguuaugauacuccucaucgcccccgccuacuccauucgaugcauaggcguaagcaacagagacuucguagaaggcaugaguggagggaccugggucgacguaguccucgaacacggcggcugcgucaccguaauggcgcaagacaaacccacaguagacaucgagcuagucaccaccaccguaaguaacauggcagaaguccgauccuacugcuacgaagcaucaaucuccgacauggccuccgauagccggugccccacacaaggcgaagcauaccucgacaagcaaagcgacacucaguacgucugcaaaagaacacucgucgaccgaggcuggggaaauggaugcggccuauucgguaaaggcucccucguaaccugcgccaaauucgcauguucgaagaaaaugaccggaaaaagcauacaacccgagaaccuagaauaccguauaaugcuaagcguccacggaagccaacacagcggaaugaucgucaacgacacaggccaugaaacagacgaaaaccgcgccaaaguagaaauaaccccuaacucaccaagggcagaagcaacccuaggcggauucggaagccuaggacucgacugugaaccaaggacaggacucgacuucucagaccuauacuaccucaccaugaacaacaaacacuggcugguccacaaagaaugguuccacgacauuccgcuaccguggcaugcuggcgccgauacaggcacgccccauuggaacaacaaagaagcacucguagaguucaaagacgcccacgcaaaacgccaaaccgucgugguccuagggagccaggaaggagccguccacaccgcccucgccggagcccucgaagccgaaauggacggcgcaaaaggccgcuuaagcuccggccaccuaaaaugccgccugaaaauggacaaacucaggcucaaaggcguaagcuacucgcuauguaccgcagcauucacauucagcaaaaucccagcagaaacacuacacggcacagucacagaagaaguacaguacgccggcaccgacggccccugcaaaguccccgcgcaaauggccgucgauaugcaaacacuaacacccguaggccgacuaauaacagcaaaccccguaaucaccgaaagcaccgaaaacagcaaaaugaugcuggaacucgacccgcccuucggagacucauacaucguaauaggcgucggagaaaagaaaaucacucaccacuggcaccgcuccggcagcaccaucggcaaagccuucgaagccaccguccgcggcgccaagcgaauggcgguacuaggcgacacagccugggacuucggaucaguuggaggagcccuaaacucacuaggcaagggcauacaccaaaucuucggagcagccuucaaaucccuauucgggggcaugagcugguucagccaaauccuaaucggaacccuccucauguggcucggccuaaacaccaaaaacggcuccauuagucuaaugugccuagcccucggcggcgugcucaucuuccuauccacagcgguaucagccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9574 - RNA, 2290 nt, Artificial Sequence
  KU681081.3 prME-short mRNA Design 3 opt
gggagaaagcuuaccaugaccucagucggaauaguaggacuacuccucacgacagcaauggccgcagaaguaaccagacgcgguuccgccuacuacauguaccucgaccgcuccgacgccggagaagccaucagcuuccccacaacccuaggcaugaacaaaugcuacauacaaaucauggaucucggacacaugugcgacgccaccauguccuacgaaugccccaugcucgacgaaggaguagagccggacgacguugacugcuggugcaacacaacauccacguggguagucuacggaaccugccaucacaagaaaggcgaagcccgaagaucccgccgcgccgucacacuacccagccacucaacgcggaaacuccaaacaagaucgcaaaccuggcuagaaagcagagaauauaccaaacaccuaaucagaguagagaacuggauauucaggaacccaggcuucgcacuagccgccgcagccauagccuggcuccucgguuccuccacaagccaaaaaguaauauaccucgucaugauacuccucaucgcaccagcauauucgauacguugcauaggagugagcaauagagacuucguagagggaaugucaggaggcaccuggguagacgucguacucgagcacggcggauguguaacaguuauggcccaagacaaacccaccgucgacauagaacucgucacaaccacagucucaaacauggccgaaguaagauccuacugcuacgaggcuuccaucucagacauggcauccgacucacgcugcccaacccaaggcgaagcguaucucgacaaacagucugacacccaguacgucugcaaacgcacacucguggacagaggauggggcaacggaugcggccucuucggcaaaggcucccuaguaacaugcgccaaauucgcaugcuccaagaaaaugaccggaaaaagcauacagcccgaaaaccucgaauaccgcauaaugcuaucaguccacggaucccaacacuccggcaugaucguaaacgacaccggccacgaaaccgacgaaaaccgcgcgaaagucgaaaucacccccaacagcccacgagccgaagccacacuagguggcuucggaagccucggacuggacugugaaccccgcacaggccuagacuucagcgaccuuuacuaccucaccaugaacaacaaacacuggcucguacacaaagaaugguuccacgacauaccacuaccguggcacacaggagcagacaccggaacaccacacuggaacaacaaagaagccuuaguagaguucaaagacgcccacgcaaaacgacaaacagucguaguacucggcucucaagaaggagccguccacaccgcacuagcaggcgcccucgaagccgaaauggacggagcuaaaggcaggcugagcucgggccaccuuaaaugcagacucaaaauggacaaacuuagacucaaaggaguaucauauucccucugcacagcagcauucaccuuuaccaaaauaccagccgaaacccuacacggaaccgugaccguagaaguucaauacgcaggaaccgacggcccaugcaaaguacccgcacaaauggcaguggacaugcagacccugacaccggucggacgccucauaacagccaaccccgucaucacugaaggcacagaaaacucgaaaaugaugcucgaacuagacccacccuucggcgacuccuacauagucaucggcgucggugaaaagaaaaucacacaccacuggcacagaagcggcucaacaaucggaaaagccuucgaagccaccguccgcggugcgaaaagaauggcaguccucggcgacacagcaugggauuucggaagcguaggcggaguacuaaacucgcucggcaaaggcauacaccaaaucuuuggcgcagccuucaaaagccuauucggaggcauguccugguucagccagauccuaaucggcacacuccuaauguggcugggacucaauaccaaaaacgggagcauaucccucaugugccuugcacuaggcggcguucucaucuuccucuccacagccgucagcgcgugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9575 - RNA, 2290 nt, Artificial Sequence
  KX827309.1 prME-short mRNA Design 3 opt
gggagaaagcuuaccaugaccagcgucgguauagucggcuuacuccucacaacagcaauggcagccgaggucacccgaagaggaucagccuacuacauguaucuggaccgaucagacgcaggggaagcaaucuccuucccaacaacccuaggcaugaauaagugcuacauacaaauaauggaccucggacacaugugcgacgccacgauguccuacgaaugcccaaugcuugacgagggcguagaaccagacgacgucgacuguuggugcaacaccacguccacgugggucgucuacggaaccugccaccauaagaaaggcgaagcgcgacguagcagacgagcagucacucuaccaagccacagcaccagaaaacuacaaacaagaagccaaaccuggcuagaaagccgagaguacaccaaacaccuaauccgcguagaaaacuggaucuucaggaacccuggcuucgcacucgccgcagcagcaaucgccuggcugcucggaucaagcacaagccaaaaaguaauauaccuugugaugauccugcuaauagcccccgccuacuccauacgcugcauaggagucucaaaucgcgacuucguugaaggcauguccggcggcacaugggucgacguagugcucgaacacgguggcugcgucacagucauggcccaggacaaaccaacaguagacauagaacuuguaaccacuaccgucaguaacauggccgagguacguucauacuguuaugaagcauccauaucggacauggccucagacucccgaugcccaacccaaggcgaagcguaccucgacaaacaaucagacacacaauaugucugcaaacgcacccuagucgacagaggcuggggaaacggaugcggacucuucggaaaaggcucccucguaaccugcgcaaaauucgcgugcucaaagaaaaugacgggcaaaagcauacaacccgaaaaccucgaguaccgcaucaugcuaucaguccacgguucacagcauagcggcaugauaguaaacgacacaggacacgagacagacgagaaccgcgcaaaagucgagauuacaccuaauaguccccgcgcagaagccacauuaggcggauucggaagccugggacuagacugcgaaccucgaaccggacucgacuucuccgaccucuacuaccucaccaugaacaacaaacacuggcugguccacaaagaaugguuccacgacauccccuuaccauggcacgccggcgcggacacaggcaccccacacuggaacaacaaagaagcccuagucgaguucaaagacgcccacgccaaaagacaaacuguagucguccuaggaagccaagaaggagcagugcacaccgcacuggcaggcgcccuagaagcagaaauggacggcgccaaaggcagacugagcucaggccaccuaaaaugccgacucaaaauggauaaacuccgauuaaaaggggucucauacucccucugcaccgccgccuucacuuucacaaaaauccccgccgaaacccuccacgguaccgucaccgucgaaguacaauacgccggcaccgacggccccugcaaaguccccgcccaaauggccguagacaugcaaaccuuaaccccagucggacgccucaucacagcaaaucccgucaucaccgaauccaccgaaaacucgaaaaugaugcucgaacuagacccaccauucggagacagcuacaucgucaucggaguaggugaaaagaaaauaacccaccacuggcaccgcagcggaagcaccauaggaaaagccuucgaggccaccguccgaggagcaaaaagaauggcgguucucggugacaccgcaugggacuucggcagcguaggcggagcucugaacagccuaggaaaaggaauccaccaaauuuucggggccgcauucaaaagccucuucggaggaauguccugguucucgcaaauacucauuggcacacuccucauguggcucggacucaacacaaagaacggcagcaucagccucaugugccucgcccuugguggcguccucauauuccucagcacagccgucucagccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9576 - RNA, 2290 nt, Artificial Sequence
  KU955593.1 prME-short mRNA Design 3 opt
gggagaaagcuuaccaugaccagcgugggcauagucggacuccuacucaccaccgccauggccgucgaagucacgcgccggggcaacgccuacuacauguaccuagaccguagcgacgcaggagaggcaauaucauuccccacaacaaugggaaugaacaaaugcuacauccagaucauggaccuaggccacaugugcgacgcaacaaugucauacgaaugcccaaugcucgacgaaggaguggaacccgacgacguagacugcuggugcaacacaacaagcaccuggguaguauacggaacgugccaccacaagaaaggcgaagcccgacggucccggcgagccgucacccucccaagccacuccacacgaaaauuacaaacaaggagccaaaccuggcucgaaagccgagaguacaccaaacaccucaucagaguggaaaacuggaucuuccgaaacccuggauucgcgcucgccgcagcagccauagcauggcuucucggcuccaguaccagccagaaaguuaucuaccucguaaugauccuacucaucgcuccagcauacuccauccgaugcaucggcgucagcaaccgcgauuucgucgaagguaugagcggcggcacauggguagacgucguacuagaacacggcggcugugugacagucauggcucaggacaaaccaacagucgauaucgaacucguaaccacaaccgucuccaauauggcagaagucagaucauauugcuacgaagcaagcaucuccgacauggccagcgacucacguugcccaacccaaggcgaagccuaccuggacaaacaguccgacacccaauacguaugcaaacgaacccucguugaccgaggcuggggcaacggcugcggccucuucggcaaaggaucacucguaacaugcgccaaauucgcuugcucaaagaaaaugacgggaaaaagcauacaacccgaaaaccuagaguaccguauaaugcucuccguccauggaucccaacacucaggcaugaucgucaacgacacgggccacgaaacagacgaaaaccgcgcaaaagucgaaauaacacccaacagcccccgagccgaagcaacacucggaggcuucgguagccucggccuagacugugaaccgcgcacaggacuagacuuuagcgaccucuacuacuuaaccaugaacaacaaacacuggcucguccacaaagaaugguuccacgacauaccauugcccuggcacgcaggggccgacacaggcaccccacacuggaacaacaaagaagcccucguagaguucaaagaugcacacgcuaaaagacaaaccgucgucguacucggcagccaagaaggcgccguacacacagcccuugcgggcgcacuagaagcagaaauggacggagccaaaggccgacugucauccggccaccucaagugcagacucaaaauggacaaacuccgccuaaaaggcguuuccuacagccucugcaccgccgccuucacauucaccaagauucccgcggaaacucuccaugggaccgucacaguagaaguacaauacgcaggaacagacggccccugcaaaguccccgcccagauggccgucgacaugcaaacccugacccccgucgggcgucuaaucacagccaacccgguaaucaccgaaucgaccgaaaacucaaaaaugaugcuagaacuugacccgcccuucggcgacuccuacaucgucauaggcguaggcgaaaagaaaauaacccaucacuggcaccgauccgguagcaccauagggaaagccuucgaagccaccguacgcggagcaaaaagaauggccguccucggagacacagcaugggacuucggaucgguaggcggagcacucaauucacuaggcaaaggcauacaccagaucuucggcgcagcauucaaaagccucuucggcggaaugagcugguucagccaaauccuaauaggaacccuacugguuuggcuaggccucaacaccaaaaacggcucaaucagccucaugugccuugcccuaggaggcguccucauauuucuaucaacugcagucucagcaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9577 - RNA, 2290 nt, Artificial Sequence
  KY272987.1 prME-short mRNA Design 3 opt
gggagaaagcuuaccaugaccuccguaggcauagucggacuccucuugaccacagccauggcagccgaagucacccgacgcggcagcgcauacuacauguaccuagaccguuccgacgcaggcgaagcaauuagcuuccccaccacccuaggcaugaacaaaugcuacauacaaauaauggaucucgggcacaugugcgaugccacaaugucguacgaaugccccaugcucgacgaaggaguagaacccgacgacgucgacugcuggugcaacacaaccaguacauggguagucuacggaaccugccaccacaagaaaggugaagcucggagaucccgacgcgcggucacccuccccucccacuccacaagaaaacugcaaacaaggucacaaacauggcucgaaagcagagaauacaccaagcaccuaauaagaguggaaaacuggauauuucggaaccccggcuucgcguuagccgcagccgccaucgcguggcuccuagggagcucaacuucacaaaaaguaauauaccucgucaugauccuccugauagccccagccuacuccauacguugcauaggcguaucuaaccgcgacuucgucgaaggaauguccggaggcacaugggucgacgugguacucgaacauggcggcugcguaaccguaauggcacaagacaaaccgacgguagacauagaacugguuacaaccaccgucagcaacauggccgaaguaagaucauacuguuacgaagcaucaaucagcgacauggccagcgacucccgcugccccacccaaggagaagcguaucucgacaagcaauccgacacccaauauguaugcaaacgcacccucguggaccgaggauggggcaacggaugcggccuauucggcaaaggaucccuagucacaugcgcgaaguucgcaugcucaaagaaaaugaccggaaaauccauacaacccgagaaucucgaauacagaaucaugcucuccguacacgggucucaacauuccggcaugaucgugaacgacacuggccacgaaaccgaugaaaaccgagcaaaagucgagauaacaccaaauucaccccgcgccgaagccacccuaggaggcuucggaagccuaggccucgacugcgaaccccgaaccggacuggacuucuccgaccuguacuaccucacaaugaacaacaaacacuggcuaguccacaaagagugguuccacgacauaccacuucccuggcacgccggcgccgauacagggacaccccacuggaacaacaaagaagcccuuguagaguucaaagacgcacacgcaaaacgccaaacagucgugguccuaggcagccaagagggagccguacacaccgcccuagccggagcccuagaagccgaaauggacggcgccaaaggcagauuaagcuccggccaccucaagugccgacuaaaaauggauaaacugcgccuuaaaggcguaagcuacucccucuguacagcagcauucacauucacaaaaauacccgccgagacacuccacggaacaguaacagucgaaguccaauacgcaggaacagauggacccugcaaagucccggcacaaauggccguagacaugcaaacccuaacccccgucggcagacucauaaccgcaaaccccgucauaacagagucaaccgaaaacucaaaaaugaugcuggaacucgacccacccuucggcgacagcuacauaguaauaggcguaggcgaaaagaaaauaacacaccacuggcaccgcagcggaucaaccaucgggaaagccuucgaagccacgguccgaggcgcaaaaagaauggccgugcucggcgacacagccugggacuucggcagcgucggcggagcccucaacucccuaggcaagggcauucaccaaaucuucggagccgccuucaaaagccucuucggaggcaugucgugguucucccaaauacuaaucggcacccuccuuauguggcugggccucaacaccaaaaacggcuccaucucgcuagucugccuagcccucgggggaguccucauauuccuuucgacagcaguaagcgcaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9578 - RNA, 2290 nt, Artificial Sequence
  KY007221.1 prME-short mRNA Design 3 opt
gggagaaagcuuaccaugaccucaguuggaauaguggggcuacuacuaaccacagccauggcggcagaaguaacccgaagaggcagcgccuacuacauguaccucgaccgcagcgacgccggcgaagcaaucagcuucccaaccacccuaggaaugaacaaaugcuacauccaaaucauggaccuaggucacaugugcgacgccaccaugagcuacgaaugccccaugcuugacgaaggaguugaaccagacgacgucgacugcuggugcaacaccacaagcaccugggucgucuacgggaccugccaccacaagaaaggcgaagcgcgccgaagccgcagagcugucacccuccccagccacuccacccgaaaacuacaaaccaggagccaaacauggcucgaaagccgcgaauauaccaaacacuuaaucagaguggagaacuggauauuccgcaaccccggauucgcacucgcagcggcagcgaucgcauggcuccuaggcagcuccaccagccaaaaagucaucuacuuagucaugauccuccucauagcccccgccuacucgaucagaugcaucggcguuaacaaccgagacuucgucgaaggcaugucuggcggcaccuggguugacgucguccuagagcacggcggcugcguaaccguaauggcucaagacaaacccaccgucgacaucgagcuagucacaaccaccguaagcaacauggccgaaguucgaagcuacugcuacgaagcauccauuagcgacauggcaucagacucaaggugcccaacacaaggagaggcuuacuuagacaaacaaagcgacacgcaauacgugugcaaacgcacccuagucgaccgcggauggggcaacggcugcggccucuucgguaagggcagccugguaaccugcgcaaaauucgccugcucaaagaaaaugacaggaaaaagcauacagcccgaaaaucucgaauaccguauaaugcuaagcguccacggaucacaacacagcggaaugaucgucaacgacaccggacacgaaacagaugaaaaccgagccaaagucgaaaucaccccaaacagcccccgcgcugaagccacccugggcggguucggaucacuaggccuagacugcgagccgcgcacaggccuggacuucagcgaccucuacuaccuaaccaugaacaacaaacacuggcucguacacaaagaaugguuccacgacaucccacucccauggcacgccggcgcagacaccggaaccccgcacuggaacaacaaagaagcacucgucgaguucaaagacgcccacgccaaacgccagacagucgucguccugggaucccaagaaggcgccguccacacagcacucgccggcgcccuagaggccgaaauggacggagcaaaaggacgccuaucaaguggccaucucaaaugccggcuuaaaauggacaaacuuagauugaaaggcgucuccuacucucucuguaccgcggccuucacauucacaaaaauacccgcggaaacacuccacggcacagucaccgucgagguccaguacgcagggaccgaugggccgugcaaaguaccagcccaaauggccguagacaugcaaacacuaacccccgucggacgucuaauaacagccaaccccgucauaacggaaucaacagagaacuccaaaaugauguuagaauuagacccuccauucggcgacucguacaucgucauagggguaggagaaaagaaaaucacacaccacuggcaccgcagcggaagcaccauaggcaaagcguucgaagccaccguacgaggcgccaaacgcauggccguccucggagauaccgccugggacuucggaagcgucggcggagcccucaacucucuaggaaaaggcauccaccaaauauucggagccgcauucaaaagccuauucggaggcaugucaugguucucccaaauacucaucggaacgcucuuaauguggcuaggccucaauaccaaaaacggcuccauaucccuagucugcuuagcccucggcggcguccuaauauuccuaagcaccgcaguaagcgcaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9579 - RNA, 2290 nt, Artificial Sequence
  EU545988.1 prME-short mRNA Design 3 opt
gggagaaagcuuaccaugacaucaguagggaucgucggucugcuccugaccacagcaauggcaguggaagucacacgacgcggcagcgcguacuacauguaccucgaccgaucagacgcaggcgaagcaaucuccuuccccaccacacucggcaugaacaaaugcuacauccaaaucauggaccuaggacacaugugcgacgcaacaaugucauacgaaugcccaaugcuggacgaaggaguagaacccgacgacgucgacugcuggugcaacacuaccagcacaugggucguauacgggacuugccaucacaagaaaggggaagcaagacgcucacgacgagcggucacgcucccgagccacucaacacggaaacuccaaacucggucgcaaaccuggcuagaaucaagagaguacacaaaacaccuaauacgaguagaaaacuggaucuucagaaacccaggcuucgcccucgccgcggccgccaucgccuggcuccuaggcagcagcaccucccaaaaagucauauaccugguaaugauccuacugauagcaccagccuacucaaucaggugcauaggaguaagcaaccgagauuucguagaaggaauguccggaggcacauggguagacgugguccuggaacacggcggaugcgugacagucauggcccaagacaaaccagccgucgauauagaacucgucaccacaaccguaagcaacauggcagaaguaagauccuacugcuacgaagccagcauaagugacauggcaagcgacagccgcugccccacccaaggcgaagccuaccucgacaaacaaucagacacccaguacguaugcaaacgcacauuaguagacagaggcuggggcaacggcugcggacuauucgggaaaggcucgcugguaaccugcgccaaauucgcgugcuccaagaaaaugaccggcaaaagcauacagcccgaaaaccucgaauaccggauaauguuguccgugcacggcagccaacacuccggcaugaucgucaacgacaccggacaugagacagacgaaaaccgcgccaaaguagaaauaaccccuaacagcccgcgagccgaggcgacccucggagguuucggcucguuaggccucgauugcgaaccccguaccggacuagacuucuccgacuuauacuaccucacgaugaacaacaaacacuggcuuguacacaaagaaugguuccacgacauaccacugcccuggcacgccggcgcagacacaggcaccccacacuggaacaacaaagaggcccuaguagaauuuaaagacgcccaugcaaaacgccaaacaguaguaguccucggcagccaagaaggcgcagugcacacagcacuagccggagcccuagaggccgaaauggacggcgcaaaagggcgacuaaguagcggacaccuaaaaugccggcucaaaauggacaaacuccgccucaaaggcgucuccuacucccuaugcaccgcagcauuuacauucacaaaaauccccgcagaaacccuacauggaaccgugacaguagaaguccaauacgcaggaacggacgggccaugcaaagugcccgcacaaauggcaguagacaugcaaacacucacaccagucggcagacuaaucaccgcgaaucccgugauaaccgaaucaaccgaaaacagcaaaaugaugcuagaacuagacccacccuucggcgacaguuacauagucauaggcguaggagaaaagaaaaucacacaccacuggcaccgauccggaucaacaauaggaaaagcguucgaagcgaccguacgcggagccaaacgaauggcaguucucggagacacagccugggacuucggaagcguaggcggcgcgcuaaacagccucggcaaaggcauccaucagaucuucggagcagcguucaaaucacuauucggagggaugagcugguucagucagauacuaauaggcacauuguuaguguggcucggccuaaacacgaaaaacggcagcaucagcuuaaccugccucgcacucggcggcguacucauuuuucuaagcaccgcaguaucagccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9580 - RNA, 2290 nt, Artificial Sequence
  KU681082.3 prME-short mRNA Design 3 opt
gggagaaagcuuaccaugacaucagucggcaucguaggccuccuucuaacaaccgcaauggccguagagguaacgcgucgaggcucagcguacuacauguaccuggaccgaucagacgcgggggaggcgauaucguucccaaccacgcucggaaugaacaaaugcuacauacaaauaauggacuuaggacacaugugcgacgccaccauguccuacgaaugccccaugcucgacgaaggaguggaaccagacgacgucgacugcuggugcaacacaaccaguaccuggguagucuacggcacgugccaccacaagaaaggcgaagcccgccgcucccgccgagcugucacacucccaagccauagcacacgcaaacugcagaccagaagccaaaccuggcucgaaucuagagaauauacaaaacaccugauccgcguagagaacuggauauucagaaacccaggauucgcccuagccgcagcagucaucgccuggcuacucggauccagcacaucacagaagguaauauaccucguaaugauauuacucaucgcaccagcguauucgauccggugcaucggcguaagcaaccgagacuucguugaaggaaugucaggcgggaccugggucgacgucguccuggaacacggaggaugcguuacggucauggcacaagacaaacccacagucgacaucgaacucgucacaacgaccguaaguaacauggcagaaguacgguccuacugcuacgaagcuagcauaucagacauggcuucagacuccagaugccccacacagggcgaagccuaccuagacaaacaaucagacacgcaauacgucugcaaacgaacccucguagaccgaggcuggggaaacggcugcggccucuucggcaaaggaucgcucgugaccugcgccaaguuugcaugcuccaagaaaaugacaggcaaauccauacaacccgagaaccucgaauaccgcaucaugcucagcguccacggaucacaacacucgggaaugauagucaacgacaccgggcacgagaccgacgaaaaccgcgccaagguggaaauaacaccuaacagucccagagcagaagccacacucggcggauucgggucacucggccucgacugcgaaccacgaaccggacuagacuucagcgaccucuacuaccugacaaugaacaacaaacacuggcuuguacacaaagaaugguuccacgauauaccacucccauggcacgccggggccgauaccgguaccccacacuggaacaacaaagaggcacucguagaguucaaagacgcacacgcaaaacgccaaaccgucgucguacucgggucacaagaaggcgccgugcauacagcccucgcuggcgcccuagaagccgagauggacggcgcuaagggucgacuuuccucaggccaccuaaaaugccgccugaaaauggacaaacuccggcucaaaggggucuccuacucacucugcaccgcagccuucacuuucaccaagauacccgccgaaacccuccacggcaccgucaccgucgaaguccaauacgcaggaaccgacggacccugcaaaguacccgcucaaauggcgguagacaugcaaacccugacgcccgucggccgccuaauuaccgccaauccugucauaaccgaaucgacagaaaacagcaaaaugaugcucgaacuggacccacccuucggcgacagcuacauagucaucggcgucggcgaaaagaaaaucacccaccacuggcaccgauccgguagcaccauaggaaaagcauucgaagccaccguacggggagcaaaaagaauggcgguacugggcgacaccgcaugggacuucgggagugucggaggagcccuuaacucguuaggcaaaggcauacaccagauauucggcgccgccuucaaaagccuguucggcggcaugagcugguucagccaaauccuaaucgggacacuccuggucuggcuaggccucaacaccaagaacggauccauuagccuaaccugccuggcacucggaggaguucuaauauuccucagcaccgccgucagcgcaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9581 - RNA, 2290 nt, Artificial Sequence
  KX601167.1 prME-short mRNA Design 3 opt
gggagaaagcuuaccaugacgagcguaggcauaguaggccuccuacuaaccaccgcaauggccguagagguaacccgccgaggcucagccuacuacauguaccuagaccgaagcgacgccggcgaagccaucagcuuucccacgacccuaggagucaacaaaugcuacauacaaauaauggaccucgggcacaugugcgacgcaaccaugucauacgagugcccaaugcuagacgaaggagucgaacccgaugacgucgauugcugguguaacaccaccucaacgugggucgucuacggaacaugccaccacaagaaaggcgaagcacggcggagcagacgagcagucacgcuaccaucccacucaacacgcaaacuccaaacccgaucacaaacauggcucgaaucccgcgaauacaccaaacaccuaaucagaguagaaaacuggaucuuucgcaaccccgguuucgcacucgcagcagccgcuaucgcauggcuacuaggcucauccaccucacagaaagucauuuaccucgugaugauccuacuaaucgcacccgcauacucgauccgcugcauaggaguuagcaaccgcgacuucguagaaggaaugagcggcggcacauggguagacguagugcuagaacacggcggcugcgucaccgucauggcccaggacaaacccacgguagacaucgaauuagucacuacaacggucagcaacauggcagaaguccgcucauacugcuacgaggcaagcaucuccgacauggcuuccgacagccgcugucccacgcagggcgaagccuaccuagacaaacaauccgacacacaauacgucugcaaaaggacccuaguagacagaggauggggaaacgggugcggacucuucggaaaaggcagccucgugaccugcgccaaauucgccugcucaaagaaaaugaccggaaaaagcauccaacccgaaaaucucgaguacagaaucaugcucagcguccacggaucacaacacagcggcaugauagucaacgacacggggcacgaaacggaugaaaaccgcgccaaagucgaaaucacccccaacagcccccgagccgaagccacccucggcggguucggaucgcuaggacucgacugcgaaccacgaacaggccuggacuucagcgaccucuacuaccuaacgaugaacaauaaacacuggcuaguacacaaagaaugguuucacgacaucccacuccccuggcacgccggagccgacaccggaacaccccacuggaacaacaaagaagcacugguugaguucaaggacgcacacgcaaaacgccagaccgugguugugcuaggcucacaagaaggcgcaguacacaccgcccuggcaggagcucuagaagccgagauggacggagccaaagggcgccucagcuccggacaccucaaaugccgccuaaaaauggacaaacuccgacuaaaaggagucucuuacucacucugcaccgccgcauucaccuucaccaaaauacccgcagagacccuccacggcacagugaccgucgaaguacaauacgccggaacagacggcccaugcaaaguaccggcccaaauggccguagacaugcaaacacucaccccagucggcagacuaaucacagcaaaccccgucauaacagaauccacagagaacagcaaaaugaugcucgaacuagauccgcccuucggcgauagcuacauaguaaucggugucggagacaagaagaucacccaccacugguaccgauccgguagcaccaucggcaaagcauucgaagccaccguccgaggcgccaaaagaauggcaguccucggcgacaccgcgugggacuucggcagcguaggaggagcccucaacucccucggaaaaggcauccaccaaaucuucggcgccgccuucaaaagccuauucgguggaaugagcugguucucccagauccugauuggcacgcuucuaguauggcuaggccuaaacacgaagaacggcagcauaucccucacgugccuugcgcuaggcggcguacuaauauucuuaagcaccgccguaagcgcaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9582 - RNA, 2290 nt, Artificial Sequence
  KX694533.2 prME-short mRNA Design 3 opt
gggagaaagcuuaccaugaccagcgucggcaucgugggccuccuccuaacuaccgccauggccgucgaagucacacgccgcggcagcgcguauuacauguaccuggacagaagcgaugccggaaaagccauaucauuccccaccacccuaggaguuaauaaaugcuacauacaaaucauggaccucggccacaugugcgacgcaaccauguccuacgaaugcccaaugcuagacgaaggcguagaaccugacgacguggacugcuggugcaacaccacaucaaccugggucguuuacggcacaugccaccacaagaaaggggaagcccgacgcuccaggcgcgcggucacccucccaucacacucaacccgcaaacuacaaacacgaucccagacuuggcuagaaucgcgcgaauacaccaaacaccucaucagagucgagaacuggaucuuccgaaaccccggcuucgcacuagcagccgcugccauagcaugguuauuaggcucgagcaccucacagaaagugauauaucucgucaugauacugcucaucgcgccagcguacuccauucggugcauaggcguaagcaacagagacuucgucgaaggcauguccggcggaaccuggguagacgucguccucgaacacgguggcugcgugaccguaauggcccaagacaaacccacaguagacaucgaacugguuaccacaaccguauccaacauggccgaagugcgcucauauugcuaugaagccagcaucucagacauggcaucggacucccgcugcccaacacaaggagaagcguaccucgacaaacaaagcgacacccaguacgucugcaaaaggacacucgucgacagaggcuggggcaacggaugcggccucuucggcaaaggcagccucguaaccugcgccaaauuugccuguagcaagaaaaugaccggcaaaagcauacaacccgaaaaccucgaauaccggauuaugcucagcguccacggcucacaacacagcggcaugaucgucaaugacauaggccacgagaccgacgaaaaccgcgccaaagucgagaucacccccaacuccccacgcgcagaggcaacucucgggggauucggcucccucggcuuagacugcgaaccccgaaccggacucgacuucucagaccuguacuaccucaccaugaauaacaaacacuggcuaguccacaaagaaugguuccacgacauaccccuccccuggcacgcaggcgcggacaccggaacaccgcacuggaacaacaaagaggcccucgucgaguucaaagacgcacacgccaaacgucaaacaguagucguacucggcucccaagaaggcgccguacauaccgcacucgccggcgcccuagaagcagaaauggacggcgccaaaggacgucuaagcuccggccaccucaaaugcagacugaaaauggauaaacuacgccucaaaggcgucagcuacucccucugcacagccgcuuucacauuuaccaaaaucccagccgaaacauuacacggaacuguuaccguagaaguccaguacgccggcaccgacggcccaugcaaagucccagcccaaauggcagucgauaugcaaacacuuacaccagucggacgccucaucacagcaaacccgguaauaaccgaaucaaccgaaaacuccaaaaugaugcuagagcucgaucccccuuuuggcgacagcuacaucgucaucggagucggggacaagaaaaucacccaccacuggcaccgcucaggcuccaccaucgggaaagcauucgaagccacaguacguggugccaaacgcauggccguacucggcgacacagcgugggacuucggcagcgucggaggcgcacucaacucacucgggaaaggcauccaccaaaucuucggcgccgcauucaaaucccuauucggcggcaugucaugguucucccaaauacuaaucggcacccuacucgucuggcuaggacucaacaccaaaaacggaagcaucagccucacgugccuagcccucggaggcguccucauauuccucuccaccgccgucuccgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9583 - RNA, 2290 nt, Artificial Sequence
  KY288905.1 prME-short mRNA Design 3 opt
gggagaaagcuuaccaugacaagcaucggcaucgucgggcuccuacucaccaccgcaauggccgcagaaaucacccgaagaggaagcgccuacuacauguaccuggaccggagcgacgcaggaaaagccauuagcuucgccaccacacuaggaguaaacaaaugucacgugcagaucauggaccuaggccacaugugugacgcgacaauguccuacgaaugcccaaugcuggaugaaggaguagaacccgacgacguggacugcuggugcaacacaacuagcacaugggucgucuacggcacaugccaccacaagaaaggagaggcccgaagaucccggcgcgcagucacccuaccgucccacaguacccgcaaacuccaaaccagaagccaaacauggcuagaaagcagagaauacacgaaacaccucaucaaaguugaaaacuggaucuuccgaaaccccggauucacgcugguagcagucgcaaucgcauggcuccuagggucuagcacuucacaaaaaguaauauaccucgucaugauccuucugauagcgccggccuacagcauacgcugcaucggaguauccaauagagacuucguagaggggauguccggcggcacaugggucgacguaguccucgaacauggaggcugugucaccguaauggcccaggacaagccaaccguagacaucgagcucguaacaaccaccguauccaacauggcggaaguaagaagcuacugcuacgaagccagcaucagcgacauggccuccgacucgcggugcccaacccaaggcgaagccuaucucgacaagcaauccgacacacaguacguaugcaaaagaacccucgucgaucgcggcuggggcaacgggugcggccucuucggaaaaggcagccucguaaccugcgcaaaauuuaccugcuccaaaaagaugaccggaaaaucaauccagccagaaaaccucgaauaccgcaucaugcucagcguccacggaagccaacauagcggcaugaucguaaacgacacaggacacgaaaccgacgaaaaccgcgcaaagguagaaguaacccccaacagcccacgcgcggaagcgacgcuaggaggcuucggaagccugggacucgacugcgaaccccgcacgggccuggacuucucagaccucuacuaccucacaaugaacaacaagcacuggcuaguccacaaagaaugguuccacgacaucccacucccguggcacgcgggcgcagacaccggaacaccccacuggaacaacaaagaggcccuaguggaguucaaagacgcacacgccaaacgacaaaccguagucguccuaggcagccaagaaggcgccguccacaccgcccucgcaggcgcccuagaagccgaaauggacggagcaaaaggacgacuauucucgggacaccucaaaugcagacucaaaauggacaaacuuagacuaaaaggggucucauacagccucuguacagcagcauucaccuucacgaaaguaccggccgaaacacuacacggaaccguaacaguagagguacaauacgcagggacggacggcccgugcaaagucccagcccaaauggcuguagacaugcaaacccuaacaccagucggccgccucauaaccgcaaacccaguuaucacagaaucaacagaaaacucaaaaaugaugcuagaacuagacccacccuucggagacagcuacauagucauaggaguuggagacaagaaaauaacacaccacuggcaccggucagggagcacaaucggaaaagccuucgaagcaaccguaagaggcgcaaaaagaauggcgguccuuggcgacaccgcaugggacuucggaucaguuggaggcguguucaacucacucgggaaaggcauacaccaaauauucggagcggcauucaaaucacuauucgggggaauguccugguucagucaaauacucauaggcacccugcuaguauggcuugggcuaaacacaaagaacggauccauaagccuaaccugccucgcacugggaggcgucaugaucuuccuaucaaccgccgugagcgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9584 - RNA, 2290 nt, Artificial Sequence
  KF268950.1 prME-short mRNA Design 3 opt
gggagaaagcuuaccaugacaucaauagggaucauaggccuccuccugacaaccgcaauggcggcugagauaacgcgccgagggagcgccuacuacauguaccuagacagaucggacgcagggaaagcaaucagcuucgccaccaacuugggagucaacaaaugccacguccaaaucauggaccucggacacaugugcgacgccacaaugucuuacgagugccccaugcuagacgaagggguagaacccgacgacguggacuguuggugcaacaccacaagcaccuggguagucuacggaaccugccaccacaagaaaggcgaagcccggagaucccgccgagccguaacccuccccucccacucgacccgaaaacuccagacaagaagucaaaccuggcuugaauccagagaauacacgaaacaccuaauaaaaguugaaaacuggaucuuccgcaaccccggcuucgcccucgccgcggucgccauagccuggcuccuaggcagcucgaccagucaaaaaguaaucuaccuagucaugauccuacucaucgccccggcauacagcauacgauguaucggagugagcaaccgagacuucgucgaaggaaugagcggcggaacuuggguagacguugucuuagagcacggcggcugcguaaccgucauggcccaggacaaaccaaccgucgacaucgagcuagugaccaccacggucucaaacauggccgaagugagaucguacugcuacgaagccuccauauccgacauggcaucagacucgagaugcccaacacaaggcgaagccuaccucgacaaacaaagcgacacacaauacgugugcaaacgcacccuaguagacagaggauggggcaacggaugcggacucuucggaaaaggcagccuagucacuugcgcgaaauucacaugcagcaagaaaaugaccggcaaaagcauacaaccggaaaaccuagaauaccgcaucaugcucagcguacacgguucacaacacuccggcaugaucgucaacgacauaggacacgaaaccgacgaaaaccgcgcaaaaguggaagucaccccaaacucaccgagagcagaagcaacacucggcggauucggaucacuaggucucgacugcgaaccgcgcacuggccuagacuucuccgaccucuacuaccuuacaaugaacaacaagcacuggcuaguccacaaagaaugguuccaugacauuccguugccauggcacgcaggagccgacacaggaacaccacacuggaacaacaaagaagcgcuaguagaguucaaagacgcccacgccaagcgucaaaccgugguaguccuaggaagccaagaaggcgccgugcacacagcacuagccggagcacucgaagccgaaauggacggugccaaagggcgacuauucagcggccaccucaaaugcaggcucaaaauggacaaacugcgacuaaaaggaguaucguacucacuaugcaccgccgccuucacauucacaaaaguaccggccgaaacccuacacggcacaguaaccguggaaguccaguacgcaggaaccgacggaccuugcaaaguccccgcccaaauggccgucgacaugcaaacacucacacccgucggcagacugauaaccgcaaacccaguaaucaccgaaagcacugagaacagcaaaaugauguuagaacuagaucccccauucggcgacucauacaucgucaucggagucggcgacaagaaaauaacccaccacuggcaccgcaguggcucaaccaucggcaaagcauucgaagccaccguacgcggcgccaaacgcauggcaguccucggugacacagcaugggauuucggaagcgucggcggcgucuucaacucccucggcaaaggugugcaccaaaucuucggcgccgccuucaagagccucuucggaggcaugucgugguucucacaaauccuuaucgggacacuccuagucuggcuaggacuaaacaccaagaacggcaguaucagccuaaccugccucgcccuaggcgggguaaugauauuccuaagcacggccguaagcgcaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9585 - RNA, 2290 nt, Artificial Sequence
  KF383121.1 prME-short mRNA Design 3 opt
gggagaaagcuuaccaugaccuccaucgggaucauaggccuauuacuaaccaccgcaauggcagccgagaucacccggcgcgguagcgccuacuacauguaccucgauagaucagaugcaggcaaagcaauauccuucgcaaccacacucggaguaaacaagugccacguccaaaucauggaccuaggccacaugugcgacgcaacaaugucauacgaaugcccaaugcuagacgagggcgucgaacccgacgacguagacugcuggugcaacaccacaagcacauggguagucuacggaacaugucaccacaagaaaggagaggccaggagaagccgacgcgcagucacccucccaagccacucgacacgaaaacuccaaacacgcagccaaacauggcuggaaagccgcgaauacaccaaacaccucaucaaaguagaaaacuggaucuuccgcaacccaggcuucgcacucguagccguagccauagccuggcuccugggaagcagcaccagccaaaaagucauauaccucguaaugauccuccugaucgcaccagccuacucgaucaggugcauuggcgucagcaaccgagacuucgucgaaggcauguccggaggcacauggguagacgucgugcuagagcacggcggcugcgucacggucauggcccaagacaaacccacgguggacauugaacucguaaccaccacagucagcaacauggcugaagucagaagcuacugcuacgaggcaucgaucagcgacauggccagugacucaagaugcccaacacaaggggaagcauaccucgacaaacagucagacacccaauacgucugcaagcgaacacucguagaccgcggcuggggcaacggcugcggacucuucggcaagggcucucuggucacaugcgccaaauucacguguagcaagaaaaugacuggcaaaucaauccaaccagaaaaucucgaauaccgaaucaugcuauccguacacggcucacaacacagcggcaugauaguaaaugacauaggucaugaaacugacgaaaacagagcaaaagucgagguaacccccaacagcccgcgcgcugaagcaacgcucggcggcuucgggagccuaggacucgacugcgaaccccgaacgggccuagacuuuagcgaucuguacuaccucacaaugaacaacaaacacuggcucgugcacaaagagugguuccacgacaucccccuccccuggcacgccggagccgacaccggcacaccccauuggaacaacaaagaagcccucguggaguucaaggacgcacacgcaaaacggcaaaccguagucguccuaggaucacaggaaggcgccguccacaccgccuuagcgggagcacucgaagcagaaauggacggcgccaaagggcgccuauucuccggacaccugaagugucgucucaaaauggacaaacuccgacuaaaaggaguguccuacagccucugcaccgcagcauucacauucaccaaaguccccgccgaaacccuccacgggacaguaacagucgaaguccaauacgccgguacagacggaccaugcaaaguccccgcccaaauggcaguagacaugcaaacacuaacccccgucgggcgacucaucaccgccaaccccguuauaacagaaagcacggaaaacagcaaaaugaugcuggaacuugacccucccuucggggacucauacauaguaauaggcgucggagacaagaaaaucacacaccauuggcaccgaagcggauccacaauaggaaaagcauucgaagccaccguacgaggggcaaaacggauggcaguacuaggcgacaccgccugggacuuuggcucaguaggcggcgucuucaacagccucgggaaaggcauccaccaaauauucggugccgccuucaaaucacucuucggcggaaugagcugguucagccaaauccugauuggaacccuacucgucuggcugggcuuaaacaccaaaaacggcagcaucucccugacaugucucgcccuagggggaguaaugauauuccuaucaaccgccgucagcgcaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9586 - RNA, 2272 nt, Artificial Sequence
  KF268949.1 prME-short mRNA Design 3 opt
gggagaaagcuuaccaugacaagcauagguaucauagggcuucuacucacaaccgccauggcagccgaaaucacccgacggggcuccgccuacuacauguacuuagacagaagcgacgcaggaaaagccaucucauucgccaccaaccuaggagucaacaagugccacguacaaauaauggaccugggacacaugugcgacgccacuauguccuacgaaugccccaugcucgacgagggcgucgaaccagacgacguugacugcuggugcaacaccacaagcacaugggucgucuacgggaccugccaccacaagaaaggcgaagcacgccggagccggcgcgccgucacgcuuccgagccacagcacccgcaaacuacaaacaagaucacagacguggcucgagagcagagaauacaccaagcaccucaucaaaguagaaaacuggauuuuccgcaaccccggauucgcucuagccgcagucgcaaucgccuggcuccuaggcucgagcacaagccaaaaagucaucuaccuaguaaugauccuccuaaucgcacccgcauacucaauacgcugcauaggcgucagcaaccgcgacuuuguagaaggaaugucaggagggacauggguagacguaguccucgaacacggaggcugcgucaccgucauggcacaggacaaacccaccguagacauagagcucguaaccacaacaguaagcaauauggcggaaguccguuccuacuguuacgaggcuucaaucucagacauggcgucagacucacgaugucccacccaaggcgaagcauaccuggacaaacaaucagacacccaauacguauguaaaaggacccucguugaccgcggcugggggaacggaugcgggcuauucggaaaaggaucccucgucaccugugccaaauucacaugcucaaagaaaaugaccggaaaaucaauccagccggaaaaccuagaauacaggauaaugcucucaguccacggaagccaacacagcggaaugauagucaacgacgaaaacagggccaaagucgagguuacacccaacagcccacgcgccgaagcaacacuaggaggauucgggagccuaggucuugacugcgaaccgcgaaccggccuggacuucucagaccucuacuaccuaaccaugaacaacaaacacuggcucguacacaaagaaugguuccacgacaucccgcucccguggcacgccggagcagacacaggcaccccacacuggaacaacaaagaggcccucguagaguucaaagacgcccacgcgaaacgccaaacaguaguaguacuggguucccaagaaggcgcaguccacaccgcgcuagcaggcgcacuagaagccgaaauggacggagccaaaggacgucuauucuccggacaccucaaaugccggcuaaaaauggacaaacuaagacucaaaggaguaucguacucccucugcacagccgccuuuacauucacgaaggucccagccgaaacccuacacggaaccgugaccgucgaaguacaauaugcgggaaccgacggcccaugcaagguaccagcccaaauggcagucgacaugcaaacccucacgcccgucggacgccucaucacagcaaauccaguaaucacagaaagcaccgaaaauucaaaaaugaugcuggaacuagacccacccuucggagacagcuacaucguaaucggcgucggagacaagaaaaucacacaucacuggcauaggagcgggagcacaauuggaaaagccuucgaagcaaccguaagaggcgccaaacgaauggcgguccuaggugacacagccugggacuucggcagcgucgggggcgucuucaacagccuaggcaaaggcauccaccaaauauucggagcagccuuuaaaagccuauucgguggcaugucaugguucagccagauccucauaggaacccugcuagucuggcuaggacuaaacacgaaaaacgggagcauaagccugacaugccucgcucugggaggcgucaugauauucuuaagcacggccguaagcgcaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9587 - RNA, 2290 nt, Artificial Sequence
  KU955595.1 prME-short mRNA Design 3 opt
gggagaaagcuuaccaugaccagcauaggaauaguaggccuccuacucacaaccgccauggcggcggagaucaccagacgaggcagcgcauacuacauguaccucgacaggucagacgccgggaaagcaaucagcuucgcaaccacacugggagucaacaaaugccacguacagauaauggaccugggacacaugugugacgcaaccaugucauacgagugccccaugcuagaugaaggaguagagcccgacgacguagacugcuggugcaauacaaccagcacaugggucguguacggaaccugccaccacaagaaaggcgaagcuagaagaagccgcagagcgguaacccuaccaagccacagcacgcgaaaacuccaaacccgaagccaaaccuggcuugagagccgggaauacacgaaacaccuaaucaagguagaaaacuggauauuccgcaaucccgguuucgcgcucgucgcagucgcaauagcauggcuccuaggaagcagcacaagccagaaagugauauaccuaguaaugauccuacugauagccccagcguacagcauccgcugcaucggcguaagcaaccgcgacuucguagaaggaauguccggaggcacauggguagacguaguccucgagcacggcggcuguguaacaguaauggcacaagacaaaccaacggucgacauagagcuagucaccacaacaguaagcaacauggcagaagugcgaagcuacugcuacgaagcauccaucucagacauggccagcgacagucgaugccccacacaaggcgaagcauaccuagacaaacaauccgacacccaauacgucugcaaaagaacgcuagucgauagagguuggggcaacggcugcggauuauucggcaaaggcucgcuagugacaugcgcgaaauucacaugcagcaagaaaaugacgggcaaaagcauccagcccgaaaaccucgaguacagaauaaugcuauccguccacggcagccaacacagcggcaugauagucaacgacacugggcacgaaacagacgaaaacagggccaaaguagaagucaccccaaacagcccacgcgcggaagcgacccucggaggguucgggucacucggacuagacugcgaaccacgaacagggcucgacuucuccgaccucuacuaccuaacgaugaacaacaaacacuggcugguacacaaagagugguuccacgacauacccuugccauggcacgcaggggcggacacaggaaccccacacuggaacaauaaagaggcgcuagucgaguucaaagacgcacacgcaaaacgacaaacaguaguaguacuaggaagccaagaaggcgcaguacacacagcacuagccggcgcgcuggaagccgaaauggacggcgcaaaaggacgacuauucagcggccaccugaaaugcaggcucaaaauggacaaacugagacugaaaggagucuccuacucacuaugcacagcagcauuuaccuucacgaaaguaccagccgaaacccuacacggaacaguaacgguagaaguccaguacgcaggaacagacgggccaugcaaaguaccagcacagauggccgucgacaugcagacccucacaccagucgggcgccuaauuacagccaacccgguaaucacagaaagcaccgaaaacuccaagaugaugcuagaacuagacccacccuucggcgacagcuacaucgugaucgguguaggugacaagaaaaucacacaccacuggcaccggagcggcagcacaauagggaaagccuucgaagcgacaguacgcggcgcgaaacgcauggccguacucggcgacaccgcaugggacuucggaagcgugggcggcgucuucaacagccucggaaaagguauccaccaaaucuucggggcagccuucaaaagccucuucgggggaaugagcugguucucacaaauacuuauagggacacugcuaguauggcucggccucaacaccaaaaacggaagcauaagccuaaccugccuagcacugggaggcgugaugauauucuuaagcacagccgucucggcaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9588 - RNA, 2290 nt, Artificial Sequence
  KF383116.1 prME-short mRNA Design 3 opt
gggagaaagcuuaccaugacgagcauaggaaucgucggacuacuacuaaccaccgcaauggccgcagaaaucacacgcagaggaagcgcauacuacauguaccuagauaggagcgaugccggcaaagccaucagcuucgcgacaacacuaggugucaacaaaugccacguacaaauaauggaccuaggccauaugugcgacgccaccaugucauacgaaugccccaugcuagacgaaggcgucgaaccagacgacguggacugcugguguaauaccacauccaccuggguagucuacggcacaugccagcacaagaaaggagaggcacgacgcucaagacgagcgguaacacuacccagccacucaacccgcaaacugcaaacgcgcucacaaacauggcuagaaucaagggaauacacaaaacaccuaauaaaagucgaaaacuggauauuccgcaaccccggcuucgcacuggucgcaguagcaauagcguggcuccuaggcucgaguaccucccaaaaagucauauaccucgucaugauccuccucauagccccagcauacuccauccgcugcaucggcgucagcaacagagacuucguagaaggcaugucuggaggcacauggguggacguggugcuagaacacggaggcugcgucaccguaauggcccaagacaaacccacagucgacaucgaacucgucacaaccacgguuagcaacauggcagagguacgcuccuacugcuaugaagccagcauaucagacauggcaagcgacucgcgcugccccacccaaggcgaagccuaccucgacaaacaaagugacacgcaauacguaugcaaaagaacccuagucgaccgaggcuggggaaacgguugcggccucuucggaaaaggcagccuaguaacaugcgccaaauucacaugcuccaagaaaaugacagggaaaagcauacaacccgaaaaccuggaauacagaaucaugcuuagcguacacggcagccaacauucagguaugauaguaaacgacaucggccacgaaaccgaugagaaccgcgccaaaguagaagucacccccaauuccccgcgcgccgaagcaacccuaggcggauucggaucacucggccuugacugcgaaccccgcacaggacucgacuucagcgaccucuacuaccuaacaaugaacaacaaacacuggcucguacacaaagagugguuucacgacaucccccuacccuggcacgccggagccgacaccggaacaccccacuggaacaacaaagaagcccuaguggaguucaaagacgcacacgccaaacgccaaaccguagucguccuaggcagccaagaaggcgccguccacacugcguuagcaggagcauuggaagccgaaauggacggggccaaaggucggcuauucagcggccaccugaaaugccgccucaaaauggacaaacuucgccuaaaaggcgucuccuauucacucugcaccgccguaugcacagcagccaaaguaccggcggaaacccuacacggcaccguaacggucgaaguacaauacgcaggaacagacgguccaugcaaaguacccgcucaaauggccguagacaugcaaacccucacccccguaggcagacuaaucaccgccaacccaguaauaaccgaaagcacggaaaacuccaaaaugaugcuagaacuagacccgcccuucggcgacagcuacaucgucauuggaguaggggacaagaaaaucacacaccacuggcacagauccggauccacaauaggcaaagcguucgaagcaaccguccgcggcgcaaaacgcauggccguccucggcgacacggcgugggacuucgguucaguaggcggagucuucaacucccuaggcaaaggaauacaccaaaucuucggcgccgcauucaaaucgcuguucggcggcaugucgugguucucacaaauacucaucgggacccuccuaguauggcugggacucaauaccaaaaacggaucaaucucacucacaugccuggcgcugggcggcguaaugauauuccuaucaacagcagucucggccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9589 - RNA, 2272 nt, Artificial Sequence
  KX601166.1 prME-short mRNA Design 3 opt
gggagaaagcuuaccaugacuagcaucggcaucgucggccuccuacugaccacagcuauggcagcagaaaucacccgacggggguccgcauacuacauguaccuagaccgcucagacgccggaaaagcgaucuccuucgcaacaacgcuaggagucaacaaaugccacguccaaaucauggaccuaggccacaugugcgacgcuacaaugagcuacgaaugccccaugcuagaugagggcguagaacccgacgacgucgacugcuggugcaacaccacuagcacguggguaguauauggcacaugccaccacaaaaagggagaagcacggcggagccgacgcgcaguaacacucccaagccacagcacacgaaaacuccaaacccguagccaaacguggcucgaauccagagaauacaccaaacaccuaaucaaaguagaaaacuggaucuuccgaaacccaggcuucgcccucguagcagucgcaauagcauggcuccuaggauccaguacaagccagaaaguaaucuaccuaguaaugauccuccuaauagcacccgccuacuccaucagaugcauaggcguaagcaaccgagacuuuguggaaggaauguccggcggaacauggguagacgucgugcuggaacacggaggcugcguaacgguaauggcgcaagacaaacccaccguagacaucgaacuggucaccaccaccguaucaaacauggcagaaguacgcuccuacugcuacgaagcgucaauaucagacauggccucggacucccggugcccaacccaaggcgaggcauaccuagacaaacaauccgacacccaauacgucugcaaacgaacccugguugaucgaggaugggguaacggcugcggacucuucgguaaaggcagucuagucaccugugcaaaauucacaugcucaaagaaaaugaccggaaaaucaauucaaccagaaaaccucgaauaucgaauaaugcucucaguacacggaagccaacacucaggcaugauagucaaugacgaaaaccgcgccaaaguugaagucaccccaaacagucccagagcagaagccacgcucggcggguucgggagccuaggacuggacugugaaccccggacgggccuggacuucagcgaccuauacuaccucaccaugaacaacaaacacuggcuaguacacaaagaaugguuucacgauauaccccucccguggcacgccggcgccgauaccggcacuccccacuggaacaacaaagaagcacuggucgaguucaaagacgcacacgcaaaacgccaaacugucguaguccucgggucccaagaaggcgccguacacacagcacucgccggcgcgcucgaggcagaaauggacggcgccaaagguagacucuucucaggacaccuaaagugccgccuuaaaauggacaaacuccgccucaaaggagugucguacuccuuaugcaccgccgcauucaccuucacaaaaguaccagccgagacacuccacggcaccguaaccguagaaguacaauacgccgggaccgacggaccaugcaagguacccgcacaaauggccguagacaugcaaacacucacgccagucggacgccucaucaccgcaaaucccgucaucacagaguccaccgagaacuccaaaaugaugcucgaacucgaucccccauucggcgacuccuacauagucaucggcgucggagacaagaaaaucacccaccacuggcaccgauccggcucgaccaucggcaaagccuucgaagccaccguaagaggcgccaaacggauggccguccugggcgacacggccugggacuucggauccgucgguggcguuuucaacucacucggaaaaggaauccaccaaaucuucggagccgccuucaaaucacuauucggaggcauguccugguucagccaaauccucaucggaacccuacucgucuggcuuggucucaacaccaaaaacggcagcaucagcuuaacaugccucgcacucggaggcguaaugaucuuucucuccaccgccgucagcgcaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9590 - RNA, 2290 nt, Artificial Sequence
  KF383118.1 prME-short mRNA Design 3 opt
gggagaaagcuuaccaugacaagcauuggcauuauaggccuacuucucaccacugccauggccgccgaaauaacacgacgaggaagcgccuacuacauguaccuagacagaucggacgcaggcaaagcaaucagcuucgcaacaacccucggagucaacaaaugccacguacaaaucauggaccuaggacauaugugcgacgcaacaaugucauacgaaugccccaugcuggacgaaggcgucgaacccgacgacguagacugcuggugcaacaccacaaguaccuggguagucuacggaaccugccaccacaaaaagggagaaacccgacggucccgcagaucaguaucccuccgcuaccacuacacaagaaaacuccaaacccgaagccaaaccuggcucgaaucccgcgaauacaaaaaacaccuaaucaugguagaaaacuggauauuccggaacccaggauucgccaucgugaguguagccaucacauggcucaugggcagucugaccagccaaaaagucaucuaccucguaaugaucgugcuaauaguacccgccuacagcaucucaugcaucggcgucucaaaccgcgaccucguagaaggaauguccggaggcaccugggucgacgugguucucgaacauggaggaugcgugacggaaauggcccaagacaaaccaaccgucgacaucgaacucguaacgaugaccgucagcaacauggcagaagucagauccuacugcuaugaagcgucccucagcgacauggcaagcgccagccgaugccccacacagggcgagcccucacucgacaaacaaucagacacacaaagcgucuguaaaagaacccucggggaccgaggcuggggcaacgggugcggcauauucggaaaagguucgcuaguaacaugcucaaaauucaccugcugcaaaaaaaugcccggcaaaucgauacaaccagagaaccucgaauacagaauaaugcuacccguacacgggagccaacacagcggcaugauaguaaacgacauaggacacgagacagacgagaacagagcaaaaguagaagucacgccaaauuccccgcgagccgaagcaacacucggaggcuucggaagccuagggcucgacugcgaaccacgcaccggccucgacuucucagaccuauacuaccugaccaugaacaacaaacacuggcuuguccacaaagaaugguuccacgauaucccucuacccuggcacgccggagcagacaccggcacaccccacuggaacaacaaagaggcccugguagaguucaaagacgcacacgcaaaacgucaaaccgucguggucuuaggcagccaagaaggcgccguacacaccgcacucgccggcgcccucgaagcggagauggacggggcuaaaggacgccuguucucaggccaucucaaaugccgucuaaaaauggacaaacuaagacuaaaaggaguaucguacagccucugcaccgccgccuucacauucaccaaaguaccggcagaaacacugcacggaacagugacaguggaaguccaaagcgccggaacagauggacccugcaaaguccccgcccagauggccguagacaugcaaacacucacacccguaggccggcuaaucacagcaaacccgguaaucaccgagucaacagaaaacuccaaaaugaugcuggaacuggauccgccauucggagacucauacauagucauagguguaggagacaagaaaauaacccaccacuggcaccgaagcggcagcaccauaggaaaagccuucgaagccacgguacgcggagccaaaagaauggccgugcucggagacaccgccugggacuucggcucaguagggggcguauucaacagccuaggaaaaggcauacaccaaaucuucggagcagcauuuaaaagccuauucggaggaaugagcugguucucacaaauacuaaucggaacccuacuaguguggcuaggacucaacaccaaaaacggcagcaucucacucacgugccuagcccugggaggagucaugauauuccucuccacagccguauccgcuugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9591 - RNA, 2287 nt, Artificial Sequence
  KX447520.1 prME-short mRNA Design 3 opt
gggagaaagcuuaccaugagcguaggcauagucggccuacuccugacgaccgcaauggccgcagaagugacacggcggggcagcgccuacuacauguaucuggacagaaacgacgcgggggaagccaucucauucccaacgacccuaggcaugaacaaaugcuacauacaaauaauggaccuagggcacaugugcgacgcaacgauguccuacgagugcccgaugcucgacgaagguguagaaccagacgacgucgauugcuggugcaacaccacauccacauggguaguauacggcacuugccaccauaagaaaggggaagcacgccgcagccgacgcgccguaacacucccuagccacuccacgcgcaaacuacaaacaagaagccaaaccuggcuagaaucuagagaauacacgaaacaccugauaagaguagaaaacuggaucuuccgaaacccgggauucgcccucgccgcagccgccauagcauggcuccucggaagcaguaccagucaaaaaguaaucuaccugguaaugauccuccuaaucgcacccgcguacagcaucaggugcaucggcgugagcaaccgcgacuucguagaagggaugagcggcggaacaugggucgacgucguccuagagcacggaggaugcgucacaguaauggcacaagacaaaccuacgguagacaucgagcucgucaccaccaccguaaguaacauggccgaaguacggucauauugcuacgaagcauccauaagcgacauggccagcgacucccgauguccaacucaaggagaagcauaccuagacaaacaaucggacacacaauacguaugcaaaagaacccucguagacagaggauggggcaacggaugcggacuauucggaaaaggcucgcuaguaaccugcgccaaauucgcgugcuccaagaaaaugacaggaaaaagcauucaaccagaaaaccuagaauacagaauaaugcuguccguacacggaagccaacauagcggaaugaucgucaacgacaccggacacgaaacggacgagaacagagcaaaaguagaaaucaccccaaacaguccccgcgcagaggcgacgcuaggagguuucggaagccuaggacuggacugcgaaccccgcacgggccucgacuucagcgaccuguacuaccucaccaugaacaacaaacacuggcuagugcacaaagaaugguuucacgacaucccccuaccguggcacgcaggcgcagacacaggaacaccgcacuggaacaacaaagaagcacuggucgaguucaaagacgcccacgcaaaaagacagacaguggugguccugggcagccaagagggagccguacacacagcgcucgcgggagcacuggaagccgagauggacggcgcaaaaggacgccuguccucaggacaccucaaaugccgacuaaaaauggacaaacucagacucaaaggagucagcuacucacuuuguacagccgccuucacauucacaaaaauaccagccgaaacacuacacggaacaguaaccgucgaaguacaguacgcaggaacagacggaccgugcaaaguccccgcgcaaauggcaguagacaugcaaacccugaccccagucggacgacuaauaaccgcaaaccccguaaucacagaauccaccgaaaauuccaaaaugaugcucgagcuagacccacccuucggcgacagcuacauagugaucggcgucggggaaaagaaaauaacccaccacuggcaccgaagugggaguacaauaggcaaagcauucgaggcaaccgucagaggggccaaacgaauggcaguacugggagacacagcaugggacuucggaucagugggcggagcccuaaacucacucggaaaaggaauccaucaaaucuucggggccgcguucaaaucacucuucgguggcaugagcugguucagccaaauacucauaggcacacuccuaauguggcucggacugaacacgaaaaacggaagcauaagccugaugugccuggcacuaggcggcguccucauauuuuuaaguacagccguaagcgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9592 - RNA, 2290 nt, Artificial Sequence
  KU761561.1 prME-short mRNA Design 3 opt
gggagaaagcuuaccaugaccuccguggggauagucggacuacuccugacaaccgccauggccgccgaaguuacccgacgaggcagcgccuacuacauguaccucgaccgcaacgacgccggcgaggcaaucuccuuccccaccacgcuaggcaugaacaaaugcuacauacaaaucauggaccucggacacaugugcgacgcaacaaugagcuacgaaugccccaugcucgacgagggagucgaacccgacgaugucgacugcuggugcaacacaaccagcaccugggucguguacggaaccugccaccacaaaaagggcgaagcgcgccgcucccggcgcgccgucacccuccccagccacucaacacgaaaacuacaaacacgaagccaaacauggcuggaaucacgagaauacaccaaacaccuaauacgagucgaaaacuggauauuccgaaaccccggcuucgcacuagccgccgcggccauagccuggcuccucggcucaucaaccucccaaaaaguaaucuaccucguaaugauacuccuaauagcccccgcauacucgauaagaugcauaggcgucagcaaccgcgacuucguagaaggaaugagcggcggcaccugggucgacguuguccuagaacacggcggaugcgucacaguaauggcccaagacaaaccuaccgucgacauagaacucgucacaacaaccguuuccaacauggccgaaguacgaucauacugcuacgaggcuucaauauccgacauggccucggacucccgcugccccacccaaggcgaagccuaccucgacaaacagagcgacacccaauacgucugcaaacgcacgcuagucgaccgcggauggggcaacggcugcggacuauucgggaaaggaucccuaguaacaugugcaaaauucgccugcucaaagaaaaugacggguaaaucaauccaaccggaaaaccucgaguaucgaaucaugcucuccguccauggcucccaacacuccggcaugauaguaaaugacacaggccacgaaaccgaugaaaacagagcuaaaguugaaauaacccccaacucaccacgcgccgaagccacccugggcggcuuuggaucacugggccucgacugcgaaccccgaaccggucucgacuucagcgaccuguacuaccuaacaaugaacaacaaacacuggcuaguccacaaggagugguuccacgacaucccacucccauggcacgccggagcagacacaggcaccccacacuggaacaacaaggaagcccuagucgaguucaaagacgcacacgcaaaacgacaaacggucgucguccuagggagccaagaaggagcaguacacacagcacucgcaggggcgcuagaagcagaaauggacggggcaaaaggacgccuuuccagugggcacuuaaagugcagacucaaaauggacaaacuuagauuaaaaggcguaucauacucacuaugcaccgccgccuucaccuucaccaaaauacccgccgaaacgcugcacggaacagucacgguugaaguccaauacgccggcacagacgggcccugcaaaguacccgcgcaaauggcggucgacaugcagacacuuacccccguuggucggcuaauaacggccaacccagucauaacagaaagcaccgaaaacuccaaaaugaugcuagaacucgacccacccuucggagacagcuacaucgucaucggcguuggcgaaaagaaaaucacacaucacuggcacagaucagguagcaccauaggcaaagccuuugaagccacagucagaggcgccaggcguauggcaguccucggagacaccgccugggacuuuggauccgugggaggcgcacuaaacucccuaggcaaaggcauccaucaaauauucggggccgccuucaaaucgcuguucggcggaaugucaugguucagccaaauccuaaucggaacgcuccuuauguggcucggccuaaacaccaaaaacggauccauaucccucaugugccuggcccucggaggcguccuaaucuuccuguccacagcggucuccgcgugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9593 - RNA, 2290 nt, Artificial Sequence
  KX806557.2 prME-short mRNA Design 3 opt
gggagaaagcuuaccaugaccuccguuggcaucgugggccuccuccuaacaaccgcaauggccgccgaaguaacccgacguggaagugcauacuacauguaccuagaccgcaacgacgcaggagaagcaaucucauucccaaccacccuaggcaugaacaaaugcuacauccaaaucauggaccuaggccacaugugcgacgcaaccaugucauacgaaugccccaugcuagacgaagguguugaaccagacgacguagacugcuggugcaacacaacauccaccuggguagucuacggcacaugccaccacaaaaagggagaagcacggcgcucccgccgagccgucacccugcccagucacuccacccgcaaacuccaaacccgaucccaaaccuggcuagaaagccgcgaauacacaaaacaccuaauaagaguagaaaacuggauguucagaaaccccggauucgcccucgccgcagcagccauagcauggcuccucggcucauccaccucacaaaaaguuauauaccucgucaugauccuacuaauagccccagccuauagcaucagaugcaucggcgucuccaaccgagacuucgucgaaggaaugucaggaggaaccuggguggacgucgugcucgaacacgggggcugcgugaccguaauggcacaagacaaaccaacgguagacaucgagcuagucacaacaacuguguccaacauggccgaaguacgaagcuauugcuacgaagcauccaucucggacauggccagcgacucucgaugccccacccaaggcgaagcauaccuggacaaacaauccgacacccaauacguaugcaaacguacucuaguagaccgcggcugggggaacgguugcggacuguucggaaaagggucacugguaaccugcgcaaaguucgcgugcucuaagaaaaugaccggaaaauccauccaaccagaaaaccuagaauaccgcaucaugcuauccguccacggaucccagcacaguggaaugauugucaacgacaccggacaugaaacagacgaaaaccgcgccaaaguagaaauaacaccaaacucaccccgcgccgaagcaacacucggcggauucggcucacucggacucgacugcgaaccccgcaccggccucgacuucucagaccuguacuaccucacaaugaacaacaaacacuggcucguacacaaagaaugguuccacgacauaccacucccuuggcacgcgggcgccgacacagguaccccacacuggaacaacaaagaagcccuagucgaguucaaagacgcacacgccaaaagacagacgguagucgugcucggaagccaggaaggagccguacacaccgcccucgccggggcacuggaagcagaaauggacggcgcuaaaggccgccucucauccggccaccuaaaaugccgguuaaaaauggacaaacugagacucaaaggaguaagcuacuccuuaugcaccgccgccuucaccuucaccaaaauaccggccgaaacccuccacgguaccguaacaguagaaguccaauacgccggaacagacggccccugcaaagucccugcccagauggcugucgacaugcaaacccucacccccgucggaagacuaaucacugccaaccccgucauaaccgaauccaccgaaaacagcaaaaugauguuggaacucgaucccccauuuggcgacucauacaucgugauaggcguaggcgagaaaaagauaacacaccacuggcaccguuccggaaguaccaucggcaaagcauucgaagcgaccguccgaggcgcaaaacgaauggccguacucggggacacggccugggacuucgggagcgugggcggcgcacuaaacucccucggcaaaggaauccaccaaaucuucggcgccgccuucaagucccucuucggaggcaugucgugguucucccagaucuuaaucggaacucuacucauguggcuaggguugaacaccaaaaacggaucaauaucccuaaugugcuuagcccuuggaggaguacuaaucuuccuaagcaccgcagugucagccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9594 - RNA, 2290 nt, Artificial Sequence
  LC191864.1 prME-short mRNA Design 3 opt
gggagaaagcuuaccaugaccaguguaggcauagugggacuacuacucacuaccgccauggcagccgaaguaacaaggcgaggauccgcguacuacauguacuuagaccgcaacgacgcaggagaagcaaucuccuuucccaccacacucggaaugaacaaaugcuacauccaaauaauggaccuaggccacaugugcgacgccacaauguccuacgaaugcccgaugcucgacgaaggagucgagccagaugacguagacugcuggugcaacaugaccagcaccugggucgucuacggcaccugccaccacaaaaaaggagaggcgcgaagauccagacgggccgucacacuaccaagucacuccacgcguaaacuccagaccagaagccaaaccuggcucgaaucgcgagaauacacaaaacaccuaauccgcgucgagaacuggauauuccguaaccccggauucgcccuagcagccgccgcaaucgccuggcuacuaggcagcucaaccagccaaaaaguuaucuaccuugucaugauacuccucauugcgccagcauacucgaucagauguauuggugucaguaaccgcgacuucguagaaggcauguccggcggaacaugggucgacgucguucucgaacacgggggaugcgucaccgucauggcacaagacaaaccaaccgucgacauagaacucguaacuacaaccgucuccaacauggccgaaguccgcagcuacugcuacgaagccagcaucucagacauggcgagcgauucccgcugccccacgcaaggcgaagccuaccuagacaaacaaagcgacacccaauacguauguaaacggacccucgucgacagaggauggggcaacggcugcggccuuuucggcaaaggcagccuaguaaccugcgccaaauucgccugcagcaaaaaaaugaccggaaaaagcauucaaccugaaaaccuagaguaccgcaucaugcucuccguccacggaucgcaacacuccggcaugauagucaaugacaccggacacgaaaccgacgaaaaccgugcgaaaguggaaaucaccccuaauagccccagggccgaagccacacucggcggauucggcagccuagggcuagacugcgaacccagaacaggccuagacuucagcgaccuauacuaccucacaaugaacaacaaacacuggcuaguccacaaagaaugguuccacgacaucccacuaccauggcacgcuggagccgacacagggacuccccacuggaacaacaaagaagcgcucguagaguucaaagaugcacacgcaaaacggcaaacagucguaguccuaggcucacaggaaggcgcgguccauacagcccucgcaggagcacucgaagcagaaauggacggagccaaaggccgacuaagcagcgggcaccucaaaugcagacucaaaauggacaaacucagacugaaaggcguaagcuacagccuuugcacagcagccuucaccuuuaccaaaauacccgccgaaacccuacacggcaccguaacgguagaaguucaauacgcaggcaccgacggaccaugcaagguccccgcacaaauggccgucgauaugcagacccuaacccccgucggacgccucaucaccgccaacccagucauaaccgaaagcacagaaaacucgaaaaugaugcucgaacuagacccacccuucggagacucauacaucguaaucggagucggagaaaaaaaaauaacacaucacuggcaccgauccggcucaacaauaggcaaagccuucgaagcaacaguacgaggagcgaaacggauggccguacucggagacacagccugggacuucggcagcgucggaggagcccucaacagcuuaggaaaaggcauccaccaaauauucggagccgcauucaagucccuguucggcggcauguccugguucagccaaauacuaauaggcacgcuacugauguggcucggacucaacaccaaaaacggcagcaucagccucaugugccucgcgcucggaggcguccucauauuccuuucaaccgcagucucagcgugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9595 - RNA, 2290 nt, Artificial Sequence
  KU744693.1 prME-short mRNA Design 3 opt
gggagaaagcuuaccaugacaagcgucgggaucgugggccuccuacuaacgaccgcaauggcagcagaggucacccgcagaggaagcgcauacuacauguaccuagaccgaaacgacgccggagaagcaaucagcuuccccacaacccucggcaugaacaaaugcuacauacagaucauggaccuaggacacaugugcgacgccaccaugagcuacgaaugcccgaugcuagacgaaggcgucgaaccagacgacgucgacugcuggugcaacacaacaagcacauggguagucuacggaaccugccaccauaagaaaggcgaagcgcgcagaagccggcgagcaguaacccuaccaagccacuccacaagaaaacuacaaaccagaucacagaccuggcucgaaagccgggaauacaccaaacaccucauccgcgucgaaaacuggaucuucagaaaucccggcuucgcccuagcggcagccgccaucgccuggcuauuaggcagcaguaccucccagaaaguaauauacuuagucaugauacuacuaauagcgccagcguacucgauacgaugcauaggagucagcaaccgagacuucgucgaaggcaugagcggagggacguggguggacguaguacucgaacacggaggcugcgucacggcgauggcucaagacaaacccacagucgacaucgagcuagucaccacaaccguaagcaacauggccgagguaagaucauacugcuacgaggcauccauaagcgacauggcaagugacucaagaugccccacacaaggagaagcauaccucgacaaacaguccgacacccaauacgucuguaaaagaacccuaguagacagaggcuggggcaacgggugcggacuauucggcaaaggcagccucgugacaugcgcgaaauucgcuugcuccaagaaaaugacaggcaaauccauccaacccgaaaaccucgaauaccgcauaaugcuaagcguacacgggucccaacacuccggcaugcuggugaacgauaccggacacgagaccgacgaaaacagagcgaaaguagaaauaaccccaaauagcccgcgagcagaagcaacucuaggcggauucggcagccuuggacuagacugcgaaccaagaacaggccucgacuucucagaccuauacuaccucaccaugaacaacaaacacuggcucgcgcacaaagaaugguuccacgauaucccccuccccuggcacgcaggcgcagcaacgggaacaccacacuggaacaacaaagaagcccucgucgaguucaaagacgcgcacgccaaaaggcaaaccgucguaguacuaggaucccaagaaggagccguccacaccgcacucgccggagcacuagaagccgagauggacggcgcaaaaggacgacucuccagcggccaccucaaaugccgacucaaaauggacaaacugcgccuuaaaggcgucucguacuccuuaugcacggccgccuucaccuuuacaaaaauacccgcagagaccguagacggcaccgucaccguagaagggcaguacgggggaaccgauggaccuugcaaaguaccagcccaaauggcaguagacaugcagacccuuacacccguaggacgacuaauaacagccaaccccgucauaaccgaauccaccgaaaacagcaaaaugaugcuagaacuagaucccccauucggcgacucauacaucgugaucggggucggagaaaagaaaauaacccaccacuggcacaggagcgggagcacaaucggcaaagccuucgaagccaccguacggggcgccaaacgaauggccguucucggcgacacagcaugggacuucggcucggucggcggagcacuaaacagccucggaaaaggaauacaccaaauaauaggcgcggccuucaaaucacuauucgggggcaugagcugguucagccaaauacugauagggacgcugcugauguggcucggacugaauacgaaaaacggcuccaucagucuaaugugccuagcccuaggaggcguacugauauuccucagcacagcaguauccggcugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9596 - RNA, 2281 nt, Artificial Sequence
  KU963574.2 prME-short mRNA Design 3 opt
gggagaaagcuuaccaugggcgccgacgccagcaucggcaucgucucccuacuccuaacaaccguaauggcagcagagauaacgcgacgaggauccgcguacuacauguaccuagacagaagcgacgccggcaaggccaucucauucgucacaacgcuaggcgucaacaaaugccacguucaaauaauggaucucggccacaugugugacgcuaccaugagcuacgaaugcccaaugcucgacgagggcgucgaacccgacgacguggacugcuggugcaacaccaccucaacaugggucguauauggcacgugccaccacaagaaaggcgaagcccgccgaucaaggagagccgucacccucccaagccacucaaccagaaaacuccaaaccagaagccagaccuggcucgagagccgagaauacacaaaacaccugauaaaaguagaaaacuggaucuuccgaaacccaggcuucgcgcuagucgcaguagccauagccuggcuccucggcagcuccacaucacagaagguuauauaccuagucaugauacuccucaucgccccagcauacagcauccgcugcauaggcguaagcaaccgcgacuucgucgaggggauguccggaggaacgugggucgacguagugcuagaacacgguggcugcguaaccgucauggcgcaagacaaaccgaccgucgacaucgagcuagucacaacgacaguaucaaacauggccgaaguacgaagcuacugcuacgaagccagcaucagcgacauggccucagacagcagauguccaacccaaggagaagcauaccucgacaaacaaagcgacacgcaauacgucugcaaacgcacccuaguagaccguggauggggcaacggcugcggccuguuuggaaaaggcucacuggucacaugugccaaauuuacaugcagcaagaaaaugacgggcaaaagcauacaaccagaaaaccuagaauaccgcaucaugcuaagcguccacggaagccaacacuccggaaugauagucaacgacgaaaaccgagcaaaagucgaaguaacacccaacucaccaagagcagaagcaacacucggcggcuucggaagccugggccuagacugcgaacccagaaccggacuagacuucagcgaccuguacuaccucaccaugaacaacaaacacuggcucguccacaaggaaugguuccacgacauaccacuaccauggcacucaggagccgacaccgaaaccccacacuggaacaacaaagaagcacugguggaauuuaaagacgcacacgccaaaagacagaccgucguaguccucgggagccaagaaggcgccguccauacagcacuggccggagcccuagaggccgaaauggacggagcaaaaggacgccuaucauccggccaccucaaaugccgccucaaaauggacaaacuccgacuaaaaggcguauccuacucccugugcaccgccgcauucacauucacaaaaguaccagccgaaacacugcacggcacggugaccguagaaguccaauacgcaggacgcgacggcccaugcaagguccccgcacaaauggcaguagacaugcagacauuaacgccagucggaagacucauaaccgccaaccccgucauaacugaaagcaccgaaaacucaaaaaugaugcuugaacuagacccacccuucggagacuccuauaucgucauaggaguaggcgacaagaaaauaacacaccacuggcacagaucaggcagcauaaucgggaaagccuucgaggccacaguccgcggcgccaaacgcauggcaguccuaggggacacagcaugggacuucggcuccgugggcggaguuuucaacucccuaggaaagggaauccaccaaaucuucggcgccgccuucaaaucacucuucggaggaauguccugguucucucaaauccuaaucggaacccuacucgucuggcucggccuaaacaccaagaacggcagcauaagccuaaccugccucgcgcucggaggcguaaugauauuccucucaacugcggucagcgcaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9597 - RNA, 2299 nt, Artificial Sequence
  KF383120.1 prME-short mRNA Design 3 opt
gggagaaagcuuaccaugggagcagacaccagcaucggaaucauaggacuacuccuaacaacagcuauggcggccgaaaucacgagaagaggaagcgcauacuauauguaccucgaccguuccgacgcaggcaaagcgauaucauucgcaaccacaaugggcgugaacaaaugccacguccaaaucauggaccuaggucacaugugugacgccaccaugucuuacgaaugccccaugcucgacgaaggagucgaacccgacgacguagacugcuggugcaacaccaccuccacauggguuguguacggaacaugccaucacaagaaaggagaagcccggccgucccgccgcgcaguaacgcucccgagccacuccaccagaaaacuacaaacccgcucacaaacauggcucgaaagucgcgaguacacaaaacaucucauaaaagucgaaaacuggauacuacgcaacccaggcuucacaguggccgcgcucgccauggccuggcuacugggaaacaguacgagccagcgcguaaucuaccucguaaugauucuccugaucgcacccgcauacuccauacgcugcaucggcguuagcaaccgcgacuucguagaaggaauguccggaggaaccuggguagacgugguccuagaacacggaggaugcgucaccgucauggcccaagacaaaccaacagucgacauagagcuaguaacaaccacggucuccaacauggccgaagucagaagcuacugcuacgaagcauccaucagcgacauggcaagcgacucccgcugucccacacaaggggaagccuaccucgacaaacaguccgacacacaauacgucugcaaacgaacccucguggaucgcggauggggcaacggaugcggacucuucggaaaaggaagccuagugaccugugcaaaguucacgugcuccaagaaaaugacaggaaaauccauacaacccgaaaaccucgaauaccggaucaugcucagcguccacggaucccagcacagcggaaugauagugaacgacauaggccacgaaaccgacgaaaaccgagcaaaaguggaagucaccccuaauucaccccgcgcagaagcaacacugggcggcuucggcagccucggccuagacugcgaaccgcgcaccggacuagacuuuucagaccuguacuaucuaacaaugaacaacaaacacuggcuuguccauaaagaaugguuccacgacaucccccucccauggcaugcaggcgcagacacaggcacaccccacuggaacaacaaagaggcacucguggaguucaaagacgcacacgccaaaagacaaaccgucguaguacucggcucccaagaaggagcaguccacaccgcucuggcaggagcauuggaggcagaaauggacggcgcgaagggccgacucuucucaggacaccucaaaugccggauaaaaauggacaaacuaaggcuaaaaggcgucagcuacucacucugcaccgccgcauucacauucagcaaagucccggcagaaacgcuccacggaacagucacgguggaggugcaauacgccggccgagacggacccugcaaaguccccgcccaaauggcaguagacaugcaaacgcucacccccguaggaagacuuaucacggccaacccaauaauaacagaauccaccgaaaacagcagaaugaugcucgagcucgacccucccuucggcgacucauacauaguuaucggaguaggcgacaagaaaaucacgcaccacuggcacaggucaggcagcacaaucggaaaagccuucgaagccaccguccgcggcgcaaaaagaauggccguacucggcgacacagccugggacuuuggaagcgucggcggagucuucaacucacuagggaaaggaguucaccaaguauucggagccgccuucaaaucgcuauucggcgggauguccugguucucgcaaauccucaucggaacccuucuagucuggcucggacugaacaccaaaaacggaagcaucucccuagcaugccuagcccucggcggugcaaugauauuccuaagcacggccguaagcgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9598 - RNA, 1582 nt, Artificial Sequence
  KU321639.1 solE mRNA Design 3 opt
gggagaaagcuuaccaugucgcaaaaggucauauaccuggucaugaucuuacucauagccccggcauacagcauaagauguauaggagucucgaacagagacuucgucgaaggaaugagcggaggcacguggguggacauaguccuggaacacggaggaugcgugaccgugauggcgcaagacaaaccgaccguggacauagaacugguaacaaccacggucucgaacauggccgaggucaggagcuacugcuacgaagcaagcauaagcgacauggcaagcgauaguagaugcccgacacaaggcgaggcauaucuagacaaacaaagcgauacccaauacguauguaagcgcacauuaguggaccgaggauggggaaacggcugcggacuguucgggaaaggaagccuagucacgugugcgaaguucgcgugcagcaagaaaaugaccggcaaaucgauacaacccgagaaccuagaauacagaauaaugcuaagcguacacgggagccagcacucgggcaugaucguaaacgacaccggacacgagaccgacgaaaaccgagcgaaaguggaaauaacacccaacucgccccgagcagaggccacccuaggaggauucggcucgcucgggcuagacugcgagcccaggacuggucuagacuucucagacuuguacuaccucacgaugaacaacaagcacuggcuaguacacaaggaaugguuccacgacauaccacugcccuggcacgcgggagccgacacagguacaccccacuggaauaacaaggaggcccucguggaguucaaagacgcccacgcaaaacgccaaaccgugguaguacucggcagccaggaaggggccguccacacggcccuggcaggggcacuggaagcggaaauggacggggcaaagggcagacuaucgagcggacaccuaaaaugucgccuaaaaauggacaagcuaaggcucaagggcguaaguuacagccuaugcacggccgcauucacguucacgaaaauacccgcagaaacgcuacacggcacggucacggucgagguccaauacgcgggcacagacggacccugcaaagugcccgcgcaaauggccguggacaugcaaacgcucacgcccgucggacggcucauaaccgcaaacccgguaauaaccgaaaguacggaaaacagcaaaaugaugcucgaguuagacccaccauucggggacucauacauaguaauaggcgugggcgagaaaaagauaacgcaccacuggcaccgcucgggaucuaccaucggcaaggcuuuugaagcaacaguacgcggggcaaaacgcauggccgugcucggggacacggccugggacuuuggcucgugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9599 - RNA, 1582 nt, Artificial Sequence
  KU312312.1 solE mRNA Design 3 opt
gggagaaagcuuaccaugucgcaaaaagucaucuaccuagucaugauccuacucauagcccccgccuacagcauccgcugcaucggagucucaaaccgcgacuucguugaaggcaugucaggaggcacaugggucgacgugguacuagaacacggcgggugcgucacagucauggcccaagacaaacccacaguggacaucgaacuggucaccaccacaguaucaaacauggcagaaguuagaagcuacugcuacgaggcaagcauauccgacauggccagcgacucaagaugcccaacacaaggcgaagccuaccuggacaaacaaagcgacacucaauacguaugcaaacgaacgcuaguggacagaggauggggaaacggauguggccucuucggcaaaggcagccucgucacaugcgcaaaauucgccugcucaaagaaaaugaccggaaaauccauucaacccgagaaccuagaauacagaaucaugcuauccgugcacggcagccaacacuccggaaugauagucaacgacaccggccacgaaaccgacgaaaaccgcgcaaaaguggaaauaaccccaaacucacccagagccgaagcaacacuaggcggcuucggcucccucggacuagacugcgaacccagaaccggccucgacuucucagaccuauacuaucuaaccaugaacaacaaacacuggcucgugcacaaagaaugguuccacgacauaccccuacccuggcacgcaggggccgauacaggcacaccccacuggaauaacaaagaagcccucguagaguucaaagaugcacaugcaaaacgacagaccguagucgugcucggcagucaggaaggcgccguccacacggcccuggccggagcccucgaagcagaaauggacggcgcaaaaggccgacucuccagcggacaccuaaaaugccgccuaaaaauggacaaacuacgccucaaaggcgucagcuacagccucugcacagcagcauucacguucacaaaaauaccagcagaaacacuccacggcacaguaacagucgaaguccaguacgccggcacagacggacccugcaaaguaccagcacaaauggcaguagacaugcaaacgcucacgcccguaggacgccuaaucaccgcaaauccagucaucaccgaaagcaccgaaaacagcaaaaugaugcucgaacucgaucccccauucggcgacucguacauagucaucggcgugggagaaaagaaaaucacacaccacuggcaccgcuccggaagcaccauaggcaaagccuucgaagccaccguacgcggagccaaacgcauggcaguacucggagacacagccugggacuucggcuccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9600 - RNA, 1570 nt, Artificial Sequence
  AY632535.2 solE mRNA Design 3 opt
gggagaaagcuuaccaugucgcaaaaaguaauauaccuagucaugauccuacucaucgccccagcuuacagcauacgcugcaucggggucucaaacagggacuucgucgaaggcaugagcggaggaacauggguggacgugguacuagaacacggcggaugcguaaccguaauggcgcaagacaagccuaccguagacaucgaacuaguaaccaccacagucuccaacauggccgaagucaggaguuacugcuacgaagcaagcauaagcgacauggcgagcgacagccggugcccgacacaaggugaagcauaccuagacaaacaaagugacacccaauacgucugcaaaaggacccuaguagacaggggcuggggcaacggcugcggucuauucggaaaaggcagccuagucacaugcgccaaauucaccugcagcaaaaaaaugaccggcaaaucaauccaacccgaaaaccucgaauaccgcauaaugcugagcgugcacgggucacaacacucgggaaugaucggauacgaaacagacgaagaccgcgcaaaaguagaaguaacaccgaacucgccaagagcagaagccacccucggaggauucggcucucucggacucgacugugaaccaagaaccgggcuagacuucucagaccucuacuaccuaacgaugaacaacaaacacuggcucgugcacaaagaaugguuccacgacauaccccugcccuggcacgcaggcgcagacacgggcaccccacacuggaacaacaaggaagcacuaguagaauucaaagacgcccacgccaagcgucaaacaguagucgugcucgggagccaagaaggggccguacacacggcccuagcaggggcccuagaagcagaaauggacggggcaaaaggaagacuauucuccggacaccugaaaugccgccuaaaaauggacaaacucagacuaaagggcguaagcuacagccuaugcacagccgcauucacauucacaaaaguccccgcagaaacacuacacggcaccgucaccgucgaaguccaauacgcgggcacagacggcccauguaaaauaccaguacaaauggcaguagacaugcaaacacucacgccggugggcagacucauaacagcaaacccagucauaaccgaaagcacagaaaacaguaaaaugaugcuugaacucgacccacccuucggugacucguacaucgucauaggaguaggcgacaaaaaaaucacgcaccacuggcaccgaucagggucaaccauuggcaaagcauucgaagcaacaguacgcggggccaaacgcauggccguccuaggggacaccgccugggacuucggaucaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9601 - RNA, 1582 nt, Artificial Sequence
  KU527068.1 solE mRNA Design 3 opt
gggagaaagcuuaccaugucccaaaaaguaauauaccuaguaaugauccuccucaucgcaccggccuauaguauccguugcauaggagucagcaacagagacuuuguagaaggcaugagcggcggcaccugggucgacgucguccuggaacacggaggaugcgugaccguaauggcacaagacaaaccgaccguggacaucgaacuggucacaacaacagucucaaacauggccgaagucagaagcuacugcuacgaagcaagcauaagcgacauggcgagcgacagccgaugcccaacccagggagaagcauaccucgacaaacagagcgacacacaauacguaugcaaacgaacgcucguagacaggggcuggggcaacggaugcggccuauucggaaaagggagccuagucacgugcgcgaaauucgccugcagcaagaaaaugacaggaaaaucaauccagccagaaaaccuagaguaccgaaucaugcugagcguacacgggagccaacacucaggcaugaucguaaacgacaccggacacgaaaccgacgaaaaccgcgcaaaaguagaaauaaccccaaacucaccaagggccgaagcaacgcuaggcggauucggcucacucggacucgacugcgagccaagaaccggacucgacuucagugaccuguacuaccucacaaugaacaacaaacacuggcuaguacacaaagaaugguuccacgacauaccacuccccuggcacgcgggcgcagacacgggcacaccacacuggaacaacaaagaagcccucguagaguucaaagacgcacacgccaaacgacagaccgugguaguacucggaagccaggaaggggccgugcacaccgcccuggccggcgcccuggaagccgaaauggacggagcaaaaggccgccucucaagcgggcacuuaaaaugucgccuaaaaauggacaaacucagguuaaaaggcguaagcuacagucuaugcacggccgcauucacauucaccaaaauaccagcggaaacgcuacacggcacagucacggucgaaguccaauacgcgggcacagacgggcccuguaaaguaccagcacaaauggccguagacaugcaaacacuaacaccggucggccgacucauaaccgcgaacccagucauaaccgaaagcacagaaaacaguaagaugaugcuagaacuagaucccccauucggagacagcuacauagucauaggcguaggugagaaaaagauaacacaccacuggcacagaagcggaucaaccauaggaaaggccuucgaagcaaccgugagaggggcaaaaagaauggccguacucggcgacaccgccugggacuucggcucgugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9602 - RNA, 1582 nt, Artificial Sequence
  KX421193.1 solE mRNA Design 3 opt
gggagaaagcuuaccaugucgcaaaaaguaaucuaccuagucaugaucuugcuaauagccccggccuacagcauacgcugcaucggaguaucaaacagggacuucgucgaaggaaugagcggaggcacguggguagacgugguacuagaacacggcggaugcgucaccguaauggcgcaagacaaaccaaccguggacaucgaacucguaacgaccacgguaucaaacauggccgaaguaagaagcuacugcuacgaagcaagcaucagcgacauggcaagcgauagccggugcccgacccaaggagaagcauaccuagacaaacagagcgacacccaauacguaugcaaacgaacccuaguagacaggggcuggggcaacggcugcggacuauucggaaaagggagccuagucacaugcgccaaauucacaugcagcaagaaaaugaccgggaaaucaauccagcccgaaaaccuagaauaccgcauaaugcuaagcgugcacgggagucagcacucuggcaugaucgugaacgacacgggauacgaaacagacgaaaacagagcaaaaguagaaguaacaccaaacuccccaagagccgaagccacgcucgggggauucggaucgcucggacuagacugcgaaccccguaccgggcuagacuucucagaccuauacuaccuaacaaugaacaacaaacacuggcucguacacaaagaaugguuccacgacauaccacugcccuggcacgcgggcgccgacacuggaacaccacacuggaacaacaaagaagcccuaguagaguucaaagacgcacaugcaaagagacagaccguggucguacugggaagccaagaaggagcaguacacacagcacuagcaggggcacuagaagcggaaauggacggggccaaaggaaaacuauucaguggacacuuaaagugcagacuaaaaauggacaaacuaagacucaagggcguaagcuacagccuaugcacagcagcguucacguucacgaaagugccagcggaaacgcuacacggaaccgucacugucgaaguccaauacgcgggcacagacgggcccugcaaaauccccguccaaauggccguagacaugcaaacgcuaacacccgugggaagacuaauaaccgcaaacccagucauaacagaaagcacggaaaauagcaaaaugaugcucgaacuagacccaccguucggagacagcuacauaguaauaggcguaggagacaagaaaaucacccaccacuggcaccgcucgggcucaaccauaggaaaagccuucgaagcgaccguacgcggagccaaacgaauggccguacuaggagacacggcaugggacuucggcucgugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9603 - RNA, 1582 nt, Artificial Sequence
  LC002520.1 solE mRNA Design 3 opt
gggagaaagcuuaccaugucacagaaaguaauauaccuaguaaugauacuccucauagccccggccuacuccauacgcugcaucggagucagcaacagagacuucguagagggaaugagcggcggaacauggguagacgugguccuagaacacggcggaugcguaacaguaauggcacaagacaaaccaaccguggacauagaauuggucacaaccacaguaucgaacauggccgaagucagaaguuacugcuacgaagcaagcauaagcgacauggcaagcgacagccgcugccccacccaaggagaggcauaccucgacaaacaaagcgacacacaauacguaugcaaacgaacacucguagaccggggcugggguaacggcugcggccuauucgggaaagggagccuagucacaugcgcgaaguucacaugcagcaagaaaaugaccggcaaaagcauccagcccgagaaccuagaauacagaauaaugcucagcgugcacgggagccaacacucgggcaugaccguaaacgacaucggcuacgaaacagacgaaaaccgcgccaaaguagaaguaaccccgaacucgccaagagccgaagccacccuagguggauucggaucccucggacucgacugcgaaccaagaaccggacucgacuucucggaccuauacuaccucacgaugaacaacaaacacuggcuaguacacaaagaaugguuccacgacauaccccuacccuggcacgccggagcagacacaggcacgccacacuggaacaacaaagaagcgcuaguagaguucaaagacgcccacgccaaacgacaaacagugguaguguuaggaagccaagaaggggcaguccacacagcccuggcaggagcacucgaagcagaaauggacggagccaaaggcaaacucuuuagcggacaccucaaaugccgccuaaaaauggacaaacuccgccuaaagggcguaaguuacagccugugcacggcagcguucaccuucacaaaagugcccgcggaaacacuccacggcaccgucacggucgaaguccaauacgcaggaacggacggacccugcaagauacccguacaaauggcaguagauaugcagacucucacccccgucggaagacucauaaccgccaacccgguaauaacagaaagcacagaaaacagcaaaaugaugcucgaacucgacccaccauucggggacucauacauagugaucggcgugggcgacaagaaaaucacccaccacuggcaucgcucgggcagcaccauaggcaaagccuucgaagcaacaguccgcggggcaaaacgaauggccguauuaggggacaccgcaugggacuucggcucgugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9604 - RNA, 1564 nt, Artificial Sequence
  DQ859059.1 solE mRNA Design 3 opt
gggagaaagcuuaccaugucccaaaaggucauauaccuuguaaugauccuacucauagcuccagcauacagcauacgcugcauaggcguaucaaacagagacuucguagaaggcaugagcggaggaacaugggucgacguaguacucgaacacggaggcugcgucacaguaauggcacaggacaaaccgaccguggacauagaacucgucacaaccacagucuccaacauggccgaaguaagaagcuacugcuacgaagcaagcaucagcgacauggcgucagacagccgaugcccaacacaaggcgaagccuaccuggacaaacagagugacacccaguacgugugcaaacggacacuuguagacagaggcuggggcaacggcuguggccuguucggaaaagggagccuagugaccugcgcaaaauucacaugcagcaagaaaaugacaggcaaaucaauccaaccagaaaaccucgaauacagaauaauguuauccguccacggaagccaacacuccggcaugauaguaaacgacgaaaaccgcgccaaaguagaaguaacaccaaacucacccagagccgaagccacgcucggcggcuucggaucgcuaggccuagacugcgaaccccgaacagggcucgacuucagcgaccucuacuaccucacgaugaacaacaaacacuggcuaguacacaaagaaugguuccacgacaucccccuacccuggcacgcaggcgcagauacaggcacaccgcacuggaacaacaaggaagcgcucguggaguucaaagacgcacacgccaagagacaaaccguagucguacuaggaagucaggaaggcgccguacacaccgcccucgccggagcacucgaagcagaaauggacggagcaaaaggaagacucuucagcggacaccucaaaugccgccucaaaauggacaagcuaagacucaaaggcguaagcuacagccuaugcacagccgccuucacauucacaaaaguacccgccgaaacacuccacggcacagucaccgucgaaguccaauacgccggcacagacggacccugcaaaguacccgcacaaauggccgucgacaugcaaacgcucacacccgucggcaggcucauaaccgcaaacccggucaucaccgaauccacggaaaacaguaaaaugaugcucgaacuagaucccccauucggcgacucguacauaguaauaggcgucggcgacaagaaaauuacacaccacuggcaccgauccggaagcaccauaggcaaagccuucgaagcaacaguccgcggcgccaaacgcauggccguacuaggggacacggcaugggacuuuggcucgugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9605 - RNA, 1570 nt, Artificial Sequence
  KU963573.2 solE mRNA Design 3 opt
gggagaaagcuuaccaugucacaaaaagucauauaccuaguaaugauacugcuaauagcaccagcauauagcauacgcugcaucggagucuccaacagagacuucgucgagggcaugagcgggggaacguggguggacguaguacucgaacacggcggaugcgucaccgucauggcacaagacaaaccaacaguagacauagaacuggucacaaccaccgucucaaauauggccgaagucagauccuacugcuacgaagcaagcaucuccgacauggcaagcgacagccgaugcccaacccaaggcgaagccuaccucgacaaacaaucagacacgcaauacguuugcaaacgaacccucgucgaccgaggcuggggcaacggcugcggccucuuugggaaaggaagccuaguaacaugcgcgaaauucacaugcuccaagaaaaugaccggcaaaucaauccaaccagagaaccuagaauaccgaaucaugcugagcguacacggcagccaacacucaggaaugauaggguacgaaaccgacgaaaaucgagccaaagucgaagucaccccaaacagcccacgagccgaagccacccucggaggcuucggaucacucggacucgacugcgaaccccggaccgggcucgacuucucagaccuguacuaccucacaaugaacaauaaacacuggcucguacauaaagaaugguuucacgacauaccccuccccuggcacgccggcgcagacaccggcacaccacacuggaacaacaaagaagcacucguggaguucaaagacgcccacgccaaacgccagaccgucgucguacuaggcucacaagaaggagcaguccacacagcccuagcaggggccuuagaagcggaaauggacggcgcaaaagggaaacucuucagcggacaccugaaaugccgccuaaaaauggacaaacuacgacucaaaggcguaagcuacagucuaugcacggccgcauucaccuucaccaaagucccagcagaaacacuccacggcacagucacaguagagguucaauacgcaggcacagacggccccugcaaaauacccguccaaauggccguagacaugcaaacccuaacccccgucggcagacuaaucacagccaacccggucaucacagaauccacagaaaacagcaaaaugaugcucgaacucgacccaccauucggagacucuuacauagucauaggaguaggcgacaagaaaaucacgcaccacuggcaccgauccggcuccacaauaggcaaagccuucgaagcaaccgugcgcggcgcaaaaagaauggcaguccucggagacaccgccugggacuucggcucaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9606 - RNA, 1582 nt, Artificial Sequence
  KY075939.1 solE mRNA Design 3 opt
gggagaaagcuuaccaugucgcagaaagucauauaccuggucaugauccugcucauagccccagccuacagucuacgaugcaucggaguaagcaacagagacuucgucgaaggaaugaguggaggcacauggguggacgucguccuggaacacggcgggugcgucacaguaauggcacaagacaaacccaccguagacaucgagcuagucacaaccacagucuccaacauggccgaagucagaagcuacugcuacgaagcaagcauaucagacauggcaagcgacagcagaugcccgacccagggggaggccuaccucgacaaacaaagcgacacccaauacgucugcaaacgcacccuaguggacaggggcuggggcaauggcugcggccuguucggaaaaggcagccuggucacaugcgcaaaauucgccugcucaaagaaaaugacaggaaaaagcauccaacccgaaaaccuggaauaucgcauaaugcuaucaguccacggcagccagcacucaggcaugauagugaacgacaccggacacgaaacagacgaaaaccgcgcaaaaguagaaauaaccccaaacucaccccgagccgaagcaacgcuuggcggcuucggaucacuuggacucgacugcgaaccaagaaccggacuagacuucagugaccucuacuaccucaccaugaacaacaaacacuggcucgugcacaaagaaugguuccacgacauaccauuacccuggcacgcgggcgcagacacuggaacaccccacuggaacaacaaagaagcgcucguggaguucaaagaugcccacgccaaacgccagaccguggucguacucgggagccaggaaggagcaguacacacggcccuagcaggggcccuagaagcagaaauggacggagcaaaaggcagacucucaagcggacacuuaaaaugccgccugaaaauggacaaacuacggcuaaaaggaguaaguuacagccucugcacagccgcauucacguucacgaagauaccggccgaaacacuccacggaacagucacgguagaaguccaauacgcgggcacggacgggccaugcaaaguacccgcgcaaauggcaguagacaugcaaacgcuaacacccgugggccgacucauaacagcaaaccccgucauaaccgaaagcaccgaaaacagcaaaaugaugcucgaacucgaucccccguucggagacucauacauaguaauaggcguaggagaaaagaaaaucacgcaccacuggcaccgcucaggaucaaccauaggcaaagccuucgaagccacaguaagaggggccaaacgcauggcagugcuaggcgacacagccugggacuucggaucaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9607 - RNA, 1582 nt, Artificial Sequence
  KX447516.1 solE mRNA Design 3 opt
gggagaaagcuuaccaugagcaaaaaagucauauaccucgucaugauccuccuuauagcccccgccuacucaauccgcugcaucgguguaagcaaccgcgacuucguugaaggaauguccggcggaaccugggucgacgucguccucgaacacggcggcugcgugacugucauggcacaagacaaacccaccguagacaucgaacucgucacaaccaccgucucgaacauggccgagguacggagcuacugcuacgaagcauccauaucagacauggccuccgacuccagaugcccaacucaaggagaagccuaccucgacaaacaauccgacacccaauacguaugcaaacgaacccuaguggaccgaggauggggcaacggcugcggacucuucggcaaaggcucccucgugacaugcgccaaauucgccugcucaaaaaaaaugaccggaaaauccauccaacccgaaaaccucgaauacaggaucaugcuaagcguccacggaucacaacacuccggaaugaucgucaacgacacaggacacgaaacagacgaaaaccgagcaaaaguagaaauaacaccaaacucccccagagccgaagccacccucggcggcuucggcucccuaggccuagacugcgaaccaagaacgggccucgacuucuccgaccucuacuaccucaccaugaacaacaaacacuggcucguacacaaagaaugguuccacgauaucccccuccccuggcacgccggcgccgacaccgggaccccccacuggaacaacaaagaagccuuagucgaauucaaagacgcacacgcaaaaagacaaaccgucgucguccucggaagccaagaaggcgcaguccacacagcccucgcgggagcccuagaagcagaaauggacggagcgaaaggccgccucuccagcggccaccucaaaugccgccucaaaauggacaaacuaagacugaaaggcgucuccuacucccucuguaccgcagcauucaccuucacaaaaauccccgcagaaacccuccacggcaccgucaccguagaaguccaauacgcaggcacggacggccccugcaaaguaccagcccaaauggccguagacaugcaaacccuaacccccgucggccgacucauaaccgcaaauccagucaucacagaaucgaccgaaaacagcaaaaugaugcucgaacuugaccccccauucggggacuccuacauaguaaucggcgucggcgaaaaaaagauaacccaccacuggcaccgcucuggaucuaccaucggcaaagccuucgaagccaccguacgcggagcaaaacgcauggccguccucggcgacaccgcaugggacuucggaagcugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9608 - RNA, 1582 nt, Artificial Sequence
  KX447515.1 solE mRNA Design 3 opt
gggagaaagcuuaccaugucacaaaaaguaaucuaccuggucaugauccuacucauagcccccgcauacagcauacgcugcauaggagucucaaaccgcgacuucgucgaaggaaugagcgggggaacguggguagacguaguccuagaacacggcggaugcguaaccguaauggcgcaagacaaaccaaccguagacauagagcuagucacaacaacagucucgaacauggcagaagucaggagcuacugcuacgaagcaaguauaagcgacauggccagcgauucccgaugcccgacacaaggagaagcauaccuagacaaacaaagcgacacacaauacguaugcaaacgcacccuaguagaccguggcuggggcaacgguugcggacuauucgggaaaggaagucuggucacaugcgcaaaauucgcaugcagcaagaaaaugaccggaaaaucgauacagcccgaaaaccuagaauaccgaauaaugcuaagcguacacgggagccaacacucgggaaugauaguaaacgacaccggacacgagaccgacgaaaacagagcaaaaguagaaauaacaccaaacucgccucgagccgaagcaacacucggaggcuucggaucacucggacucgacugcgagcccagaaccggccucgacuucucggaccuauacuaccucacaaugaacaacaaacacuggcucguacacaaagaaugguuccacgacauaccccugcccuggcacgcaggcgccgacacgggaacgccccacuggaacaacaaagaagcccuaguagaguucaaagacgcacacgccaaacgccaaaccguggucgugcucgggagccaagaaggagcagugcacacagcacuggccggagcccuggaagccgaaauggacggagcaaaaggaaggcucucaagcggacaccuaaaaugccgccugaaaauggacaaguuaaggcuaaaaggaguaucauacagccucugcacggccgcguucaccuucacaaaaauacccgcagaaacgcuacacggcaccgucacagucgaaguacaguacgcgggaaccgacggcccaugcaaaguacccgcacaaauggccguggacaugcaaacacuaacgccagugggcaggcuaauaaccgcaaacccagucauaacggaaagcacggaaaauagcaaaaugaugcucgaacucgacccaccguucggagacucguacauaguaauaggcguaggcgaaaagaaaauaacacaccacugguaccgcucgggcucaaccauaggcaaagcauucgaagcaaccgugcgaggcgccaaacgcauggcuguacucggagacacagcaugggacuucggcucaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9609 - RNA, 1582 nt, Artificial Sequence
  KU758874.1 solE mRNA Design 3 opt
gggagaaagcuuaccaugagccaaaaagucauauaccuagucaugauccuacuaaucgccccagcauacucaauacgcugcaucggcgucagcaaucgagacuucgucgaaggcaugagcggcggcacaugggucgacguaguccucgaacacggcggcugcgucaccgucauggcccaagacaaaccaaccguagacauagaacucgucacaacaacagucucaaacauggccgaagucagaagcuacugcuacgaagccuccauaagcgacauggcauccgacucacgcugcccaacacaaggcgaagcauaccucgacaaacaguccgacacgcaauacguaugcaaacgcacccuaguagacaggggcugggggaacggaugcggcuuauucggcaaaggcagccucgucacaugcgcgaaauucgccugcuccaagaaaaugaccggcaaauccauacagccagagaaccuagaauaccgaauaaugcucuccguccacggaucacaacacagcggaaugaucguaaacgacaccggccacgagaccgacgaaaaccgcgccaaagucgaaaucacccccaacagcccacgagccgaggccacacucggaggcuucggcucgcuaggacucgacugugaaccuagaaccggccucgacuucucagaccucuacuaccuaacgaugaacaacaaacacuggcuagugcacaaagaaugguuccacgacauaccacugcccuggcacgcaggcgcagacaccggcacgccacacuggaacaacaaggaagcccuaguagaguucaaagacgcccacgccaagcgacaaaccgucguagugcucggcucccaagaaggagccguccacacagcucuagccggagcacuagaagcagaaauggacggagccaaaggaaaacucucaagcggccaccuaaaaugccgacucaaaauggacaaauuacgacuaaaaggcguauccuacucccuaugcacagccgcauucacauucacaaaaauucccgccgaaacgcuacacggcacagucacaguggaaguacaauacgccggcacagacggaccaugcaaaguaccagcccaaauggccgucgacaugcaaacgcugacacccgucggcagacucauaacagccaaccccgucauaaccgaaaguaccgaaaacucaaaaaugaugcucgaacucgacccaccauucggagacagcuacauagucaucggcgucggagaaaagaaaauaacccaccacuggcaccgaagcggcuccacaaucggaaaagccuucgaagccacaguacggggagccaaacguauggccguacucggcgauaccgcaugggacuucggcagcugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9610 - RNA, 1582 nt, Artificial Sequence
  KU729218.1 solE mRNA Design 3 opt
gggagaaagcuuaccaugucacaaaaagucauauaucuagucaugauccugcuaauagccccagccuacagcauccgcugcaucggaguaucgaaccgcgacuucgucgaaggcaugagcggaggcaccuggguagacguaguccuagaacacggcggaugcguuaccguaauggcacaagacaagccaaccguagacaucgagcuagucaccaccaccguuuccaacauggcagaaguacgaagcuacugcuacgaagcaaguauaagcgacauggcguccgacagccggugccccacacaaggcgaagccuaccucgacaaacaaagcgacacacaguacguuugcaagcggacgcugguggaccgcggcuggggcaacggaugcggauuguucggaaaaggaagccuagucacaugcgcgaaauucgcaugcagcaagaaaaugacaggcaaaucaauacagccagaaaaccuagaauacagaauaaugcuaagcguacacggaagucaacacagcggcaugaucgucaacgacacaggccacgagaccgacgaaaacagagcaaaaguagaaauaaccccaaacucgccaagagccgaagccacacucggaggauucggcucgcucggacucgacugcgagcccagaaccggacucgacuucuccgaccuauacuaccucacaaugaacaauaaacacugguuaguacacaaagaaugguuccacgacaucccacugcccuggcacgcaggagccgacacaggcacaccccacuggaacaacaaggaagcucuaguagaguucaaagacgcccacgcgaaacgucaaaccguaguaguacuaggcagccaagaaggcgcagugcacacagcccucgccggcgcacuagaagcggaaauggacggcgcaaaaggcagauuaagcagcggccaccuaaaaugccgccuaaagauggacaaacuaagacucaaaggaguaagcuacagccuaugcacagcagcauucaccuucaccaaaauacccgccgaaacacuacacgggacaguaacagucgaaguacaguaugcaggcacagacggccccugcaaaguacccgcacaaauggccguggacacccaaacacuaacccccguaggcaggcuaauaaccgccaacccaguaaucaccgaaagcacagaaaacagcaaaaugaugcucgaacuagaucccccauucggagacuccuacaucgucauaggagucggcgaaaagaaaaucacucaucacuggcaccgaucaggcuccaccaucggcaaagcauucgaagcaaccguacgcggcgccaaacguauggccgugcuaggcgacacagccugggacuucggaucaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9611 - RNA, 1582 nt, Artificial Sequence
  KU501217.1 solE mRNA Design 3 opt
gggagaaagcuuaccaugucacaaaaagucauauacuuagucaugauacuacucauugcccccgcauacuccauacgaugcaucggcgucuccaacagagacuucguagaaggcaugagcggcggcacaugggucgacguaguccuggaacacggcggcugcguaaccgugauggcccaagacaaaccaacuguagacauagaacucgucacaaccaccguaagcaacauggccgaaauccgaagcuacugcuacgaagccagcauaagcgacauggcguccgacagccgcugcccaacccaaggcgaagccuaccuagacaaacagagcgacacacaauacgucugcaaacgcacacuaguagacagaggcuggggaaacggcugcggacuauucggaaaaggaagccuaguaacgugcgcgaaauucgccugcagcaaaaaaaugacaggaaaaucaauccagcccgagaaccuagaauacagaauuaugcuaagcguacacgggucccaacacucaggaaugauaguaaacgacacuggccacgaaaccgacgaaaacagagccaaaguagaaauaacacccaacucaccccgagccgaagccacacuaggaggcuucggcucacucggacucgacugcgaaccaagaaccggacuagacuucucggaccucuacuaccucacgaugaauaacaaacacuggcucguccacaaagaaugguuccacgacauaccccucccuuggcacgcuggcgcagacaccggaacaccacacuggaacaacaaggaagcacucgucgaauucaaagacgcccacgccaaacgccaaaccguagucguacucggaucccaagaaggggcaguacacacagcccuggccggagcacucgaagcagaaauggacggcgccaaaggacgacuaucuaguggccaccugaaaugucgccuaaaaauggacaaacuccgacucaaaggcguaagcuacagccucugcaccgcagccuucaccuucaccaaaauaccagcagaaacacuacacggcacgguaaccgucgaaguccaguacgcaggaacugacgggcccugcaaagucccagcccaaauggcagucgacaugcaaacccuuacccccguaggacgccucauaacagccaacccagucaucaccgaaagcacagaaaacagcaaaaugaugcucgaacucgacccacccuucggagacucauacauagucauuggcgugggcgaaaaaaaaauaacucaccacuggcaccgaucgggcucaacuauaggcaaagccuucgaagcgaccguccgcggcgccaaacgcauggccguacucggcgacacagccugggacuucggcuccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu
